(12) United States Patent
Terman

(10) Patent No.: US 8,524,218 B2
(45) Date of Patent: *Sep. 3, 2013

(54) COMPOSITIONS AND METHODS FOR TREATMENT OF NEOPLASTIC DISEASE

(76) Inventor: David S Terman, Pebble Beach, CA (US)

( * ) Notice: Subject to any disclaimer, the term of this patent is extended or adjusted under 35 U.S.C. 154(b) by 390 days.

This patent is subject to a terminal disclaimer.

(21) Appl. No.: 12/276,941

(22) Filed: Nov. 24, 2008

(65) Prior Publication Data

US 2009/0123444 A1 May 14, 2009

Related U.S. Application Data

(60) Division of application No. 10/428,817, filed on May 5, 2003, now abandoned, which is a continuation-in-part of application No. 12/145,949, filed on Jun. 25, 2008, which is a division of application No. 10/937,758, filed on Sep. 8, 2004, now abandoned, which is a continuation of application No. 09/650,884, filed on Aug. 30, 2000, now abandoned.

(60) Provisional application No. 60/378,988, filed on May 8, 2002, provisional application No. 60/389,366, filed on Jun. 15, 2002, provisional application No. 60/406,697, filed on Aug. 28, 2002, provisional application No. 60/406,750, filed on Aug. 29, 2002, provisional application No. 60/415,310, filed on Oct. 1, 2002, provisional application No. 60/415,400, filed on Oct. 2, 2002, provisional application No. 60/438,686, filed on Jan. 9, 2003.

(51) Int. Cl.
*A01N 63/02* (2006.01)

(52) U.S. Cl.
USPC .............. 424/93.1; 424/93.21; 435/372

(58) Field of Classification Search
USPC .............. 435/372; 424/93.1, 93.21
See application file for complete search history.

(56) References Cited

U.S. PATENT DOCUMENTS 7,247,501 B2 * 7/2007 Kim et al. .......... 436/520
2004/0057940 A1 * 3/2004 Kim et al. .......... 424/93.21

OTHER PUBLICATIONS

DeLoach et al. (Res. Vet. Sci. Mar. 1993; 54 (2): 227-234).*
Sprandel et al. (Res. Exp. Med. (Berl.) Jul. 20, 1979; 175 (3): 239-245).*
Ihler et al. (Crit. Rev. Ther. Drug Carrier Syst. 1985; 1 (2): 155-187).*
Aldrich et al. (J. Appl. Physiol. 1996; 80 (2): 531-539).*
Tonetti et al. (Biotechnol. Appl. Biochem. 1990; 12 (6): 621-629).*
Brown et al. (Magn. Reson. Med. Dec. 2003; 59 (6): 1209-1214).*
Muzykantov et al. (Expert Opin. Drug Deliv. 2010; 7 (4): 403-427).*
Terman et al. (PLoS One. 2013; 8 (1): e52543; Epub Jan. 9, 2013; pp. 1-11).*
Goldberg (Med. Hypotheses. Apr. 2010; 74 (4): 629-30).*
Lutty et al. (Curr. Eye Res. Sep. 2002; 25 (3): 163-71).*
Kirn et al., Replication-selective virotherapy for cancer: b Niological principles, risk management and future directions, Nature Medicine, Jul. 2001, pp. 781-787, vol. 7 number , Nature Publishing Group, Internet.

* cited by examiner

*Primary Examiner* — Stephen Rawlings
(74) *Attorney, Agent, or Firm* — Central Coast Patent Agency

(57) ABSTRACT

The present invention comprises the use of sickle cells or sickle cell precursors loaded with a therapeutic agent that localize in tumors and induce a tumoricidal response.

23 Claims, No Drawings

COMPOSITIONS AND METHODS FOR TREATMENT OF NEOPLASTIC DISEASE

CROSS REFERENCE TO RELATED APPLICATIONS

The instant application is a divisional of U.S. application Ser. No. 10/428,817, filed on May 5, 2003, which is a continuation in part of divisional 12/145,949, filed on Jun. 25, 2008, which is a continuation of U.S. application Ser. No. 10/937,758, filed on Sep. 8, 2004, which is a continuation of U.S. application Ser. No. 09/650,884, filed on Aug. 30, 2000, which claims priority to provisional application 60/151,470, filed on Aug. 30, 1999. All of the above referenced applications are incorporated in their entirety by reference.

BACKGROUND OF THE INVENTION

1. Field of the Invention

The invention relates generally to therapeutic compositions and methods for treating tumors and cancer.

2. Description of the Background Art

Therapy of the neoplastic diseases has largely involved the use of chemotherapeutic agents, radiation, and surgery. However, results with these measures, while beneficial in some tumors, has had only marginal effects in many patients and little or no effect in many others, while demonstrating unacceptable toxicity. Hence, there has been a quest for newer modalities to treat neoplastic diseases.

Erythrocytes from patients with sickle cell anemia contain a high percentage of SS hemoglobin which under conditions of deoxygenation aggregate followed by the growth and alignment of fibers transforming the cell into a classic sickle shape. Retardation of the transit time of sickled erythrocytes results in vaso-occlusion. SS red blood cells have an adherent surface and attach more readily than normal cells to monolayers of cultured tumor endothelial cells. Reticulocytes from patients with SS disease have on their surface the integrin complex $\alpha_4\beta_1$ which binds to both fibronectin and VCAM-1, a molecule expressed on the surface of tumor endothelial cells particularly after activation by inflammatory cytokines such as TNF, interleukins and lipid-mediated agonists (prostacyclins). Activated tumor endothelial cells are typically procoagulant. Similar molecules are upregulated on the neovasculature of tumors. In addition, upregulation of the adhesive and hemostatic properties of tumor endothelial cells are induced by viruses, such as herpes virus and Sendai virus. Sickled erythrocytes lack structural malleability and aggregate in the small tortuous microvasculature and sinusoids of tumors. In addition, the relative hypoxemia of the interior of tumors induces aggregation of sickled erythrocytes in tumor microvasculature. Hence, sickled erythrocytes with their proclivity to aggregate and bind to the tumor endothelium are ideal carriers of therapeutic genes to tumor cells.

The invention provides a method of delivering a therapeutic agent to a solid tumor characterized by hypoxia, acidosis and hypertonicity comprising loading the therapeutic agent into mature sickle red blood cells or nucleated sickle cell progenitor cell and administering the therapeutic agent into the blood circulation of a patient wherein the sickle red blood cells accumulate in the tumor, wherein the therapeutic agent loaded into the sickle cell or sickle cell progenitor is an anti-tumor virus, toxin, siRNA, drug or prodrug.

SUMMARY OF INVENTION

The invention provides method of treating tumors using sickled erythrocytes and their nucleated precursors as carriers of therapeutic agents selectively into tumors where they induce a tumoricidal response.

DESCRIPTION OF THE PREFERRED EMBODIMENTS

Provided also are compositions and methods for delivery of therapeutic nucleic acid constructs to tumor sites in vivo using therapeutic genes carried by erythrocytes from patients with sickle cell anemia which have the unique capability of adhering to sites on tumor neovasculature.

1. Cancer

This invention is used to treat any type of cancer in a host at any stage of the disease. More particularly, the cancer is a solid tumor such as a carcinoma, melanoma, or sarcoma. This invention is used to treat cancers of hemopoietic origin such as leukemia or lymphoma, that involve solid tumors. A host is any animal that develops cancer and has an immune system such as mammals. Thus, humans are considered hosts within the scope of the invention.

2. Nucleic Acid

The term nucleic acid as used herein encompasses both RNA and DNA, including cDNA, genomic DNA, and synthetic (e.g., chemically synthesized) DNA. The nucleic acid can be double-stranded or single-stranded. Where single-stranded, the nucleic acid can be the sense strand or the antisense strand.

The term isolated nucleic acid means that the nucleic acid is not immediately contiguous with both of the sequences with which it is immediately contiguous (one on the 5' end and one on the 3' end) in the naturally occurring genome of the organism from which it is derived. For example, an isolated nucleic acid molecule can be, without limitation, a recombinant DNA molecule of any length, provided nucleic acid sequences normally found immediately flanking that recombinant DNA molecule in a naturally occurring genome are removed or absent. Thus, an isolated nucleic acid molecule includes, without limitation, a recombinant DNA that exists as a separate molecule (e.g., a cDNA or a genomic DNA fragment produced by PCR or restriction endonuclease treatment) independent of other sequences as well as recombinant DNA that is incorporated into a vector, an autonomously replicating plasmid, a virus (e.g., a retrovirus, adenovirus, or herpes virus), or into the genomic DNA of a prokaryote or eukaryote. In addition, an isolated nucleic acid can include a recombinant DNA molecule that is part of a hybrid or fusion nucleic acid sequence.

Typically, regulatory elements are nucleic acid sequences that regulate the expression of other nucleic acid sequences at the level of transcription and/or translation. Thus, regulatory elements include, without limitation, promoters, operators, enhancers, ribosome binding sites, transcription termination sequences (i.e., a polyadenylation signal), and the like. In addition, regulatory elements can be, without limitation, synthetic DNA, genomic DNA, intron DNA, exon DNA, and naturally-occurring DNA as well as non-naturally-occurring DNA. It is noted that isolated nucleic acid molecules containing a regulatory element are not required to be DNA even though regulatory elements are typically DNA sequences. For example, nucleic acid molecules other than DNA, such as RNA or RNA/DNA hybrids, that produce or contain a DNA regulatory element are considered regulatory elements. Thus, recombinant retroviruses having an RNA sequence that produces a regulatory element upon synthesis into DNA by reverse transcriptase are isolated nucleic acid molecules containing a regulatory element even though the recombinant retrovirus does not contain any DNA.

3. Transfection

The term "transfection," of a nucleic acid into a cell, as used herein is intended to include "transformation," "transduction," "gene transfer" and the like, as they are commonly used in the art. "Transfection" is NOT intended to be limited to transfer of nucleic acid into a cell by means of an infectious particle such as a retrovirus, as the term may have been used originally. Rather any form of delivery and introduction of a nucleic acid molecule, preferably DNA, into a cell, whether in the form of a plasmid, a virus, a liposome-based vector, or any other vector, so that the nucleic acid is expressed in the cell and its protein product(s) made, is included within the definition of "transfection."

When a nucleic acid is said to "encode" a product other than a protein, this language is intended to mean that it encodes the necessary proteins/enzymes that are involved in, or required for, the synthesis of that product. For example, if a DNA molecule is said to encode LPS, it clearly encodes one or more proteins (enzymes) that are involved in the biosynthesis of LPS. If a nucleic acid is said to "encode the biosynthesis" of a structure, it means that the nucleic acid encodes the enzymes that participate in the creation of that structure. In particular for the carbohydrate structures referred to herein, the nucleic acids used in the invention are introduced into a cell that normally does not make, or makes little of, the carbohydrate structure so as to provide to that cell the genetic material for an enzyme or enzymes that generate the carbohydrate structure or modify a different carbohydrate structure to that one indicated.

When transfected in vitro, the cells are autologous, allogeneic, or xenogeneic to the host to provide additional immunogenicity. In addition to being transfected with nucleic acid encoding a SAg, the cells are transfected with nucleic acid encoding any other polypeptide including, without limitation, a galactosyltransferase, staphylococcal hyaluronidase and/or erythrogenic toxin, streptococcal capsular polysaccharide, CD44, tumor antigen, costimulatory molecule such as B7-1 and B7-2, adhesion molecules, MHC class I molecule and/or MHC class II molecule. Nucleic acids encoding the molecules are cotransfected with the SAgs. But for others, including but not limited to Staphylococcal hyaluronidase, erythrogenic toxin, Streptococcal capsular polysaccharide and CD44 genes, the nucleic acids encoding the SAgs are fused to other nucleic acids resulting in expression of a fusion protein. Methods for in vivo and in vitro transfection of cells are well known. For example, two books in the series Methods in Molecular Medicine published by Humana Press, Totowa, N.J., describe in vivo and in vitro transfection protocols that are adaptable to the present invention (Vaccine Protocols edited by Robinson et al., (1996) in Gene Therapy Protocols edited by Robbins et al., Humana Press, Totowa, N.J. (1997)). Transfection protocols are also discussed elsewhere ((Sambrook, J. et al., Molecular Cloning, Second Edition, Cold Springs Harbor Laboratory Press, Plainview, N.Y., (1989)). In addition, use of various vectors to target epithelial cells, use of liposomal constructs, methods of transferring nucleic acid directly into T cells, hematopoietic stem cells, and fibroblasts, methods of particle-mediated nucleic acid transfer to skin cells, and methods of liposome-mediated nucleic acid transfer to tumor cells have been described elsewhere. (Felgner, P L et al., Cationic Lipids for Intracellular Delivery of Biologically Active Molecules, U.S. Pat. No. 5,459,127, issued Oct. 17, 1995; Felgner, P L, Cationic Lipids for Intracellular Delivery of Biologically Active Molecules, U.S. Pat. No. 5,264,618, issued Nov. 23, 1993; Felgner, P L, Exogenous DNA Sequences in a Mammal, U.S. Pat. No. 5,580,859 issued Dec. 3, 1996; Felgner, P L, A Protective Immune Response in a Mammal by Injecting a DNA Sequence, U.S. Pat. No. 5,589,466 issued Dec. 31, 1996).

Nucleic acid and nucleic acid constructs of the present invention are incorporated into a vector, an autonomously replicating plasmid, or a virus (e.g., a retrovirus, adenovirus, or herpes virus). Typically, these vectors, plasmids, and viruses can replicate and function independently of the cell genome or integrate into the genome. Vector, plasmid, and virus design depends on, for example, the intended use as well as the type of cell transfected. Appropriate design of a vector, plasmid, or virus for a particular use and cell type is within the level of skill in the art. In addition, a single vector, plasmid, or virus can be used to express either a single polypeptide or multiple polypeptides. It follows that a vector, plasmid, or virus that is intended to express multiple polypeptides will contain one or more operably linked regulatory elements capable of effecting and/or enhancing the expression of each encoded polypeptide.

The term "operably linked" means that two nucleic acid sequences are in a functional relationship with one another. For example, a promoter (or enhancer) is operably linked to a coding sequence if it effects (or enhances) the transcription of the coding sequence. A ribosome binding site is operably linked to a coding sequence if it is positioned to facilitate translation. Operably linked nucleic acid sequences are often contiguous, but this is not a requirement. For example, enhancers need not be contiguous with a coding sequence to enhance transcription of the coding sequence.

A vector, plasmid, or virus that directs the expression of a polypeptide such as a SAg can include other nucleic acid sequences such as, for example, nucleic acid sequences that encode a signal sequence or an amplifiable gene. Signal sequences are well known in the art and can be selected and operatively linked to a polypeptide encoding sequence such that the signal sequence directs the secretion of the polypeptide from a cell. An amplifiable gene (e.g., the dihydrofolate reductase [DHFR] gene) in an expression vector can allow for selection of host cells containing multiple copies of the transfected nucleic acid.

Standard molecular biology techniques are used to construct, propagate, and express the nucleic acid, nucleic acid constructs, vectors, plasmids, and viruses of the invention ((Sambrook, J. et al., supra; Maniatis et al., Molecular Cloning (1988); and U.S. Pat. No. 5,364,934. For example, prokaryotic cells (e.g., *E. coli, Bacillus, Pseudomonas*, and other bacteria), yeast, fungal cells, insect cells, plant cells, phage, and higher eukaryotic cells such as Chinese hamster ovary cells, COS cells, and other mammalian cells can be used.

4. Sickled Erythrocytes as Gene Carriers

Erythrocytes from patients with sickle cell anemia contain a high percentage of SS hemoglobin which under conditions of deoxygenation aggregate followed by the growth and alignment of fibers transforming the cell into a classic sickle shape. Retardation of the transit time of sickled erythrocytes results in vaso-occlusion. SS red blood cells have an adherent surface and attach more readily than normal cells to monolayers of cultured tumor endothelial cells. Reticulocytes from patients with SS disease have on their surface the integrin complex $\alpha_4\beta_1$ which binds to both fibronectin and VCAM-1, a molecule expressed on the surface of tumor endothelial cells particularly after activation by inflammatory cytokines such as TNF, interleukins and lipid-mediated agonists (prostacyclins). Activated tumor endothelial cells are typically procoagulant. Similar molecules are upregulated on the neovasculature of tumors. In addition, upregulation of the adhesive and hemostatic properties of tumor endothelial cells are induced by viruses, such as herpes virus and Sendai virus. Sickled erythrocytes lack structural malleability and aggregate in the small tortuous microvasculature and sinusoids of tumors. In addition, the relative hypoxemia of the interior of tumors induces aggregation of sickled erythrocytes in tumor microvasculature. Hence, sickled erythrocytes with their proclivity to aggregate and bind to the tumor endothelium are ideal carriers of therapeutic genes to tumor cells.

Red blood cell mediated transfection is used to introduce various nucleic acids into the sickled erythrocytes. The extremely plastic structure of the erythrocyte and the ability to remove its cytoplasmic contents and reseal the plasma membranes enable the entrapment of different macromolecules within the so-called hemoglobin free "ghost." Combining these ghosts and a fusogen such as polyethylene glycol has permitted the introduction of a variety of macromolecules into mammalian cells (Wiberg, F C et al., Nucleic Acid Res. 11: 7287-7289 (1983); Wiberg, F C et al., Mol. Cell. Biol. 6: 653-658 (1986); Wiberg, F C et al., Exp. Cell. Res. 173: 218-227 (1987). Both transient and stable expression of introduced DNA is achieved by this method. Sickled cells can also be transfected with a nucleic acid of choice e.g., apolipoproteins, RGD in the nucleated prereticulocyte phase (e.g. proerythroblast or normoblast stage) by methods given in Example 1. Sickled erythrocytes transfected with nucleic acids encoding a SAg and/or carbohydrate modifying enzyme to induce expression of the a Gal epitope, apolipoproteins, RGD and/or any construct described herein. Nucleic acids encoding additional polypeptides alone or together with SAg as described in Tables I and II to including but not limited to angiostatin, apolipoproteins, RGD, streptococcal or staphylococcal hyaluronidase, chemokines, chemoattractants and Staphylococcal protein A are transfected into and expressed by sickled erythrocytes. These sickled cell transfectants are administered parenterally and localize to tumor neovascular endothelial sites where they induce a anti-tumor response. Protocols for use of these transfectants in the induction of anti-tumor immune response are described in Examples 3, 4, 5, 6, 7.

5. Vesicles from Sickled Erythrocytes

Vesicles from sickled erythrocytes are shed from the parent cells. The contain membrane phospholipids which are similar to the parent cells but are depleted of spectrin. They also demonstrate that a shortened Russell's viper venom clotting time by 55% to 70% of control values and become more rigid under acid pH conditions. Rigid sickle cell vesicles induce hypercoagulability, are unable to pass through the splenic circulation from which they are rapidly removed. Sickled erythrocytes are transfected in the nucleated prereticulocyte phase with superantigen and apolipoprotein nucleic acids as well as RGD nucleic acids. Nucleic acids encoding additional polypeptides alone or together with SAg as described in Tables I and II are transfected into and expressed by sickled erythrocytes. Any of the immature or mature sickled erythrocytes and their shed vesicles expressing the molecules given in Tables I and II are capable of localizing to tumor microvascular sites where they bind to apolipoprotein receptors and induce an anti-tumor effect. Because of their adhesive and hypercoagulable properties as well as their rigid structure, these sickled cell vesicles expressing superantigen and apolipoproteins are especially useful for targeting the tumor microvascular endothelium and producing a prothrombotic, inflammatory anti tumor effect. Sickled erythrocytes and their vesicles are capable of acquiring oxyLDL via fusion with oxyLDL containing liposomes as in Example 5. The resulting sickle cell or liposome expresses oxyLDL alone or together with SAg. Binding of oxyLDL to the SREC receptor on tumor microvascular endothelial cells induces apoptosis and simultaneous superantigen deposition produces a potent T cell anti-tumor effect.

Vesicles are prepared and isolated as follows: Blood is obtained from patients with homozygous sickle cell anaemia. The PCV range is 20-30%, reticulocyte range is 8-27%, fetal hemoglobin range is 25-13% and endogenous level of ISCs is 2-8%. Blood is collected in heparin and the red cells are separated by centrifugation and washed three times with 09% saline. Cells are incubated at 37° C. and 10% PCV in Krebs-Ringer solutions in which the normal bicarbonate buffer is replaced by 20 mM Hepes-NaOH buffer and which contains either 1 mM $CaCl_2$ or 1 mM EGTA. All solutions contain penicillin (200 u/ml) and streptomycin sulphate (100 ug/ml). Control samples of normal erythrocytes are incubated in parallel with the sickle cells. Incubations of 10 ml aliquots are conducted in either 100% $N_2$ or in room air for various periods in a shaking water bath (100 oscillations per mm). $N_2$ overlaying is obtained by allowing specimens to equilibrate for 45 mm in a sealed glove box (Gallenkamp) which was flushed with 100% $N_2$. Residual oxygen tension in the sealed box was less than 1 mmHg. The percentage of irreversibly sickled cells is determined by counting. 1000 cells after oxygenation in room air for 30 mm and fixation in buffered saline (130 mM Cl, 20 mM sodium phosphate, pH 74) containing 2% glutaraldehyde. Cells whose length is greater than twice the width and which possessed one or more pointed extremities under oxygenated conditions are considered to be irreversibly sickled. After various periods of incubation, cells are sedimented at 500 g for 5 mm and microvesicles) are isolated from the supernatant solution by centrifugation at 15,000 g for 15 mm. The microvesicles form a firm bright red pellet sometimes overlain by a pink, flocculent pellet of ghosts (in those cases where lysis was evident) which is removed by aspiration. Quantitation of microvesicles is achieved by resuspension of the red pellet in 1 ml of 05% Triton X100 followed by measurement of the optical density of the clear solution at 550 nm. Optical density measurements at 550 nm give results that are relatively the same as measurements of phospholipid and cholesterol content in the microvesicles. Cell lysis is determined by measurement of the optical density at 550 nm of the clear supernatant solution remaining after sedimentation of the microvesicles. Larger samples of microvesicles for biochemical and morphological analysis are prepared from both sickle and normal cells following incubation of up to 100 ml of cell suspension at 37° C. for 24 h in the absence or presence of $Ca_2$ Ghosts are prepared from sickle cells after various periods of incubation. The cells are lysed and the ghosts washed in 10 mM Tris HCl buffer, pH 73, containing 0.2 mM EGTA.

These vesicles are useful as a preventative or therapeutic vaccine as in Examples 4, 5, 6, 7.

6. Sickled Erythrocytes as Carriers of Tumoricidal Agents.

Sickled erythrocytes are known to be more adherent to microvascular endothelium than normal erythrocytes and to adhere to a greater extent under conditions of local hypoxia and acidosis. The primary pathologic defect in sickle cell disease is the abnormal tendency of hemoglobin S to polymerize under hypoxic conditions. The polymerization of deoxygenated hemoglobin S results in a distortion of the shape of the red cell and marked decrease in its deformability. These rigid cells are responsible for the vaso-occlusive phenomena which are the hallmark of the disease.

Sickle red cells adhere to the microvascular endothelium for the following reasons: Sickled cells have abnormally increased expression of $\alpha_4\beta_1$ integrin and CD36. Activation of platelets releases thrombospondin, which act as a bridging molecule by binding to a surface molecule, CD36, on an endothelial cell and to CD36 or sulfated glycans on a sickle reticulocyte. Inflammatory cytokines induce the expression of vascular-cell adhesion molecule 1 (VCAM-1) on endothelial cells. This adhesive molecule binds directly to the $\alpha_4\beta_1$ integrin on the sickle reticulocyte.

virus, autonomous parvoviruses, In addition, the adenovirus encoding thymidine kinase is transfected into tumor cells that are then susceptible to lysis ganciclovir. Various oncolytic and tumor specific viruses with tumor specificity used to transfect sickle cells are described in Table 1 of Kirn, D. et al., *Nat. Med.* 7:781-7 (2001) shown below.

TABLE 1

Examples of replication-selective viruses in clinical trials for cancer patients

| Parental Strain | Agent | Clinical phase | Tumor targets in clinical trials | Genetic alterations | Cell phenotype allowing selective replication |
|---|---|---|---|---|---|
| Engineered | | | | | |
| Adenovirus (2/5 chimera) | d/1520[a] | I-III | SCCHN Colorectal Ovarian Pancreatic | E1B-55-kD gene deletion E3-10.4/14.5 deletion | Controversial cells lacking p53 function (for example, deletion, mutation), other? |
| Adenovirus (serotype S) | CN706 | I | | E1A expression driven by PSE element | Prostate cells (malignant, normal) |
| | CN787 | I | Prostate | E1A driven by rat probasin promoter/ E1B by PSE/promoter/enhancer | |
| Adenovirus (2/5 chimera) | Ad5-CD/tk-rep | I | Prostate | E1B-55-kD gene deletion Insertion of HSV-tk/CD fusion gene | Controversial cells lacking p53 function (for example, deletion, mutation), other? |
| Herpes simplex virus-1 | G207 | I-II | GBM | ribonucleotide reductase disruption (lacZ insertion into ICP6 gene) neuropathogenesis gene mutation ($\gamma$-34.5 gene)-both copies | Proliferating cells |
| Herpes simplex virus-1 | NV1020 | I | Colorectal | neuropathogenesis gene mutation ($\gamma$-34.5 gene)-single copy | Proliferating cells |
| Vaccinia virus | Wild-type ± GM-CSF | I | Melanoma | For selectivity: none or tk deletion Immunostimulatory gene (GM-CSF) Insertion | Unknown |
| Non-engineered | | | | | |
| Newcastle Disease virus | 73-T | I | Bladder SCCHN Ovarian | Unknown (serial passage on tumor cells) | Loss of IFN response in tumor cells |
| Autonomous parvoviruses | H-1 | I | | None | Transformed cells ↑ proliferation ↓ differentiation ras, p53 mutation |
| Reovirus | Reolysin | I | SCCHN | None | Ras-pathway activation (for example, ras mutation, EGFR signaling) |

In the oxygenated state, the extent of sickle cell adhesion is density-class dependent: reticulocytes and young discocytes (SS1) greater than discocytes (SS2) greater than irreversible sickle cells and unsicklable dense discocytes (SS4). Hypoxemic conditions have no effect on adherence of normal erythrocytes but sickle erythrocyte adherence to endothelial cells is increased significantly. The least dense sickle erythrocytes containing CD36 and VLA-4+ expressing reticulocytes are especially involved in hypoxia sensitive adherence. Selective secondary trapping of SS4 (dense cells) occurs in post capillary venules where deformable SS cells are preferentially adherent. Vaso-occlusion is induced by a combination of precapillary obstruction, adhesion in post capillary venules, and secondary trapping of dense erythrocytes. This induces local hypoxia leading to increased polymerization of hemoglobin S and rigidity of SS erythrocytes. In this way the obstruction is multiplied and extended to nearby vessels.

In the present invention, sickled erythrocytes are used to carry tumoricidal agents into the microvasculature of tumors. Sickle cell trait cells are preferred since they are normal under physiologic conditions but sickle and become adhesive in the acidotic and/or hypoxemic tumor microvasculature. Tumoricidal agents introduced into and carried by sickled erythrocytes include oncolytic viruses including but not limited to herpes simplex, adenoviruses, vaccinia, Newcastle Disease Erythrocytes from subjects with sickle trait are preferred because these red cells are functionally and structurally normal in the circulation but are activated to sickle in the hypoxic tumor vasculature. Here they assume the sickled configuration, adhere to the endothelium of the tumor microcirculation and obstruct microvasculature in a manner similar to the homozygous SS erythrocytes.

In addition the sickled erythrocyte carry nucleic acids encoding tumoricidal agents including but not limited to *C. perfringens* exotoxin, pertussis toxin, verotoxins, pseudomonas exotoxins and superantigens, perforin, granzyme B, complement components (membrane attack complex), oxidized LDL, tumor specific antibodies alone or fused to toxins including but not limited to superantigens, *Pseudomonas* exotoxins, ricin, clostridia toxin. The nucleic acid encodes a hemolysin such as but not limited to *E. coli* hemolysin or staphylococcal alpha hemolysin. The sickled cell can also contain anaerobic bacterial spores such as clostridia species which can grow selectively in hypoxemic tissues. The sickled erythrocyte also carries phage displays, exosomes, sickle cell vesicles, sec vesicles expressing tumor toxins or superantigens. The toxins may be fusion proteins of toxins with ligands expressed on tumor vasculature or tumor such a EGF, inactivated factor VIII or antibodies specific for a wide variety of tumor antigens well known in the art.

The nucleic acids encoding these toxins and oncolytic and tumor specific viruses are placed under the promoter of the heat sensitive global operator (Example 8). When entering the hypoxic tumor, sickled erythrocyte adhere to the tumor vasculature. In the hypoxemic environment of the tumor, the hypoxia sensitive global promoter is activated and induces the production lytic viruses and toxins. Sickled cells are disrupted and lyse releasing lytic virus and toxin into the hypoxic tumor. As the tumor site becomes more hypoxic, VCAM-1 and p-selectin expression on tumor endothelium are upregulated trapping more circulating sickled cells in the tumor microcirculation to undergo lysis with release of tumoricidal products into the tumor area.

The sickled cell is transfected preferably with the oncolytic viruses and toxins given above at a stage preferably before it is enucleated (Examples 1, 8). Nucleated sickle reticulocytes are the preferred cell for transfection although enucleated sickled cells will also work (Example 8) Anaerobic bacterial spores such clostridia are transfected into the sickled erythrocytes by endocytosis or electroporation (Schrier S. *Methods in Enzymology* 149: 261-271 (1987); Tsong T Y *Methods in Enzymology* 149-259 (1987)). They are also introduced into sickle erythrocytes that have been lysed under hypotonic conditions and the membranes annealed with encapsulation of the anaerobic spores (Example 8).

Erythrocytes from subjects with sickle trait are preferred because these red cells are functionally and structurally normal in the circulation but are activated to sickle in the hypoxic tumor vasculature. Here they assume the sickled configuration, adhere to the endothelium of the tumor microcirculation and obstruct microvasculature in a manner similar to the homozygous SS erythrocytes.

The sickled erythrocytes are administered parenterally by injection or infusion in a therapeutically effective amount of cells. This encompasses a volume of 1-25 cc of packed cells administered i.v. over a one hour period. These cells are used in protocols given in Example 3-7.

Another preferred delivery system is the sickled erythrocyte containing the nucleic acids of choice a given in Example 6. The sickled erythrocytes undergo ABO and RH phenotyping to select compatible cells for delivery. The cells are delivered intravenously or intrarterially in a blood vessel perfusing a specific tumor site or organ e.g. carotid artery, portal vein, femoral artery etc. over the same amount of time required for the infusion of a conventional blood transfusion. The quantity of cells to be administered in any one treatment would range from one tenth to one half of a full unit of blood. The treatments are generally given every three days for a total of twelve treatments. However, the treatment schedule is flexible and may be given for a longer of shorter duration depending upon the patients response.

TABLE I

Therapeutic Constructs And Preferred Conditions Of Use

I. CELLS: Tumor Cells, DCs or DC/Tumor Cell Hybrids (DC/tc)
USE: In vivo and Ex vivo
PURPOSE A. In Vivo Preventative or Therapeutic Vaccine (Established Tumor)
       Accomplish by transfecting or co-transfecting with nucleic acid encoding superantigen plus one or more of the following:
       1. Superantigens
       2. Enzyme that modifies carbohydrate to induce Gal or GalCer epitope expression
       3. Functional hyaluronidase from microbial or human sources
       4. Staphylococcal or streptococcal erythrogenic toxin
       5. Staphylococcal protein a or a domain thereof
       6. Staphylococcal hemolysin and functional microbial toxins
       7. Functional microbial or human coagulase
       8. Costimulatory protein
       9. Chemoattractants
      10. Chemokines
      11. Nucleic acids encoding biosynthesis of lipopolysaccharides
      12. Nucleic acids encoding biosynthesis of glycosylceramides
      13. Nucleic acids encoding biosynthesis of microbial membrane or capsular lipoproteins and polysaccharides
      14. Oncogenes, amplified oncogenes and transcription factors
      15. Angiogenic factors and receptors
      16. Tumor growth factor receptors
      17. Tumor suppressor receptors
      18. Cell cycle proteins
      19. Heat-shock proteins, ATPases and G proteins
      20. Proteins engaged in antigen processing, sorting and intracellular trafficking
      21. Inducible nitric oxide synthase (iNOS)
      22. apolipoproteins (e,g,. Lp(a)) transfected into tumor cells & sickled erythrocytes used for targeting tumor microvasculature
      23. LDL and oxyLDL receptors (e.g., SCEP receptor) transfected into tumor cells and sickled erythrocytes & used for targeting to tumor microvasculature
    B. Ex Vivo Immunization of T and/or NKT cells to Produce Tumor Specific Effector Cells (for Adoptive Immunotherapy)*
       Accomplish by (i) transfecting or co-transfecting tumor or accessory cells with nucleic acid encoding the following, or (ii) providing immobilized molecules or receptors that present the following:
       1. Superantigen
       2. Superantigen receptor and transcription factor with bound superantigen
       3. CD1 receptor binding and/or expressing superantigen-glycosyl ceramide complex
       4. CD14 receptor binding or expressing superantigen-lipopolysaccharide or superantigen-peptidoglycan complex
       5. Mannose receptor binding glycosylated superantigen
       6. Glycophorin receptor TABLE I-continued

| Therapeutic Constructs And Preferred Conditions Of Use |
|---|
| 7. Superantigen-tumor peptide(s) complex on MHC or CD1-bearing APC in soluble or immobilized form |
| C. Therapeutic Molecules or Complex Applied to Transfected or Untransfected Tumor cells or Accessory Cells; or MHC class I, class II, CD1, Superantigen receptor or CD14 receptor: |
| 1. Superantigen (wherein cell may express Gal) |
| 2. Glycosylated superantigen |
| 3. Superantigen complex with |
| a. glycosyl ceramide |
| b. lipopolysaccharide |
| c. peptidoglycan |
| d. mannan proteoglycan |
| e. muramic acid |
| f. tumor peptide |
| g. glycosylceramides with terminal Gal(α1-4)Gal e.g. globotriosylceramide and galabiosylceramide |
| h. Conjugates of SAg-(Gb2 or Gb3 or Gb4) |
| i. Conjugates of SAg-(Gb2 or Gb3 or Gb4)-CD1 |
| j. GPI anchored conjugates: SAg-GPI-(Gb2 or Gb3 or Gb4) |
| l. GPI anchored conjugates: SAg-GPI-(Gb2 or Gb3 or Gb4)-CD1 |
| m. Conjugates of SAg polypeptide or nucleic acid with Verotoxin |
| n. Conjugates of SAg Polypeptide or nucleic acid with Verotoxin A or B subunit |
| o. Conjugates of SAg polypeptide or nucleic acid with IFNα receptor peptides homologous to verotoxin |
| p. Conjugates of SAg polypeptide or nucleic acid with CD19 peptides homologous to verotoxin |
| q. Conjugates of SAg polypeptide or nucleic acid with Arg-Gly-Asp or Asn-Gly-Arg |
| r. Conjugates of SAg polypeptide or nucleic acid with LDL, VLDL, HDL |
| s. Conjugates of SAg polypeptide or nucleic acid with Apolipoproteins (e.g., Lp(a), apoB-100, apoB-48, apoE) |
| t. Conjugates of SAg polypeptide or nucleic acid with oxyLDL, oxyLDL mimics, (e.g., 7β-hydroperoxycholesterol, 7β-hydroxycholesterol, 7-ketocholesterol, 5α-6α-epoxycholesterol, 7β-hydroperoxy-choles-5-en-3β-ol, 4-hydroxynonenal (4-HNE), 9-HODE, 13-HODE and cholesterol-9-HODE) |
| u. Conjugates of SAg polypeptide or nucleic acid with oxyLDL by products (e.g. lysolecithin, lysophosphatidylcholine, malondialdehyde, 4-hydroxynonenal) |
| v. LDL & oxyLDL receptors (e.g., LDL oxyLDL, acetyl-LDL, VLDL, LRP, CD36, SREC, LOX-1, macrophage scavenger receptors) as polypeptide or nucleic acid alone or with SAg polypeptide or nucleic acid intratumorally |
| II. CELLS: Specialized Tumor Specific Effector Cells (T and/or NKT Cells) |
| USE: Adoptive Immunotherapy In Vivo |
| PURPOSE: |
| A. CD44 Expression on T cells or NKT Accomplished by: (i) Superantigen stimulation; and/or (ii) transfection with nucleic acid encoding CD44 and/or (iii) transfection with nucleic acid encoding glycosyltransferase |
| B. Chimeric TCR with: Invariant a chain site for binding GalCer and Vβ chain site for binding superantigen |
| C. Dual TCR Vβ chains with sites for superantigen binding |
| D. T cells or NKT cells with overexpressed Vβ region specific for a given superantigen |
| E. T cells or NKT cells with lowered signal transduction threshold |
| III. MOLECULES: Superantigen mimics |
| USE: In Vivo Administration |
| A. Superantigen receptor-binding oligonucleotides |
| B. Superantigen oligonucleotide-peptide conjugate Oligonucleotide is specific for superantigen receptor on tumor cells Peptide has deleted class II binding site and intact TCR binding site |
| C. Phage displayed integrin ligand on tumor neovasculature - carrier for superantigen-encoding nucleic acid. |
| IV. CARRIERS: for nucleic acid encoding superantigen |
| USE Transfection of Tumors In vivo |
| A. Sickled erythrocytes that target tumor neovasculature |
| B. Phage displayed tumor neovascular integrin and superantigen receptor carrying superantigen nucleic acids |
| V. CARRIERS: constructed to co-express superantigen conjugates or complexes with: Glycosylceramide αGal Lipopolysaccharides Peptidoglycans |
| USE Transfection of Tumor Cells and/or DCs and/or DC/tc's - in vivo or ex vivo. |
| A. Liposomes |
| B. Proteosomes |

TABLE II

Nucleic Acid Constructs and Cells
SAg-encoding DNA is used alone or together with DNA encoding other cell surface moieties useful in generating antitumor immunity. Genes or their products are shown in column 1, source information is shown in column 3, preferred cells to be transformed, transfected or transduced with the DNA are shown in column 2.
All of references are incorporated by reference in their entirety.

| Gene or Gene Product | Cells transformed | Reference or Source |
|---|---|---|
| 1. SAg (SEQ ID NOS: 1-2) | Tumor | [See text] |
| 2. Enterotoxin (SEQ ID NOS 3-12) | Tumor | [See text] |
| 3. SAg receptor (SEQ ID NOS 1-2) | Tumor | [See text] |
| 4. Enterotoxin receptor (SEQ ID NOS 3-12) | Tumor | [See text] |
| 5. CD1 receptor(s) (SEQ ID NO 13-14) | Tumor | Martin, L H et al., *Proc. Natl. Acad. Sci.* 83: 9154-9158 (1986) |
| 6. CD14 receptor (SEQ ID NOS 15-16) | Tumor | Ferrero, E et al., *J. Immunol.* 145: 331-336 (1990) |
| 7. CD44 encoding nucleic acids (SEQ ID NO 17) | T or NKT | Nottenburg, C et al. *Proc. Natl. Acad. Sci.* 66: 8521-88525 (1992) |
| 8. Carbohydrate modifying enzymes (SEQ ID: NO 18) | Tumor, T or NKT | Sheng, Y et al. *Int. J. Cancer* 73: 850-858 (1997) |
| 9. TCR Vβ chain (SEQ NOS 19-20) | Tumor | Tillinghast, J P et al., *Science* 233: 879-883 (1986) |
| 10. Staph/Strep hyaluronidase (SEQ NOS: 21-22) | Tumor | Hynes W L et al., *Infect. Immun.*, 63: 3015-3020 (1995) |
| 11. Staph/Strep erythrogenic toxin (SEQ NOS 23-24) | Tumor | McShan W M, et al., *Adv. Exp. Med. Biol.* 418: 971-973 (1997) |
| 12. Staphylococcal β-hemolysin (SEQ NOS: 25-26) | Tumor | Projan S J et al., *Nucleic Acid Res.* 3305-3309 (1989) |
| 13. Strep capsular polysaccharide (SEQ NOS: 27-28) | Tumor | Lin, W S et al., *J. Bacteriol.* 176: 7005-7016 (1994) |
| 14. Staph staphylocoagulase (SEQ NOS 29-30) | Tumor | Kaida S. et al., J. *Biochemistry* 102: 1177-1186 (1987) |
| 15. Staph Protein A (SEQ NOS: 31-32) | Tumor | Shuttleworth, H L et al., *Gene* 58: 283-295 (1987) |
| 16. Staph Protein A domain D (SEQ NOS: 33-34) | Tumor | Roben, P W et al., *J. Immunol.* 154: 6347-6445 (1995) |
| 17. Staph Protein A Domain B (SEQ NO: 35) | Tumor | Gouda, H et al., *Biochemistry*, 31: 9665-9672 (1992) |
| 18. Immunostimulatory protein | Tumor, T or NKT | Tokunaga, T et al., *Microbiol. Immunol.* 36: 55-66, (1992) |
| 19. Costimulatory protein | Tumor | Entage, P C et al., J. Immunol. 160: 2531-2538 (1998) |
| 20. SAg-mimicking nucleic acid | T or NKT | |
| 21. Glycophorin (SEQ NOS: 36-37) | Tumor | Siebert, P D. et al., *Proc. Natl. Acad. Sci. USA* 83 1665-1669 (1986) |
| 22. Mannose receptor (SEQ ID NOS 38-39) | Tumor | Kim S J. et al., *Genomics* 14: 721-727 (1992) |
| 23. Angiostatin (SEQ ID NO: 40) | Tumor | Cao, Y. et al., *J. Clin. Invest* 101: 1055-1063 (1998) |
| 24. Chemoattractant (SEQ ID NOS: 41-42) | Tumor | Ames, R S. et al., *J. Biol. Chem.* 271: 20231-20234 (1996) |
| 25. Chemokine (SEQ ID NOS 43-44) | Tumor | Nagira, M et al., *J. Biol. Chem.* 272: 19518-19524 (1997) |
| 26. Transcription factor (SEQ ID NO 45) | Tumor, T or NKT | Schwab M et al., *Mol. Cell Biol.* 6: 2752-2758 (1986) |
| 27. Transcription factor-binding nucleic acid | Tumor, T or NKT | |
| 28. SAg/peptide conjugate | Tumor | |
| 29. Glyco-SAg | Tumor | |
| 30. Staph. global regulator gene agr (SEQ ID NO: 46-48) | Tumor | Balaban, N. et al., *Proc. Natl. Acad. Sci. USA* 92: 1619-1623 (1995) |
| 31. Lipid A biosynthetic genes (SEQ ID NOS: 49-56) | Tumor | Schnaitman C A et al., ge lpxA-D *Microbiological Reviews* 57: 655-682 (1993) |
| 32. Mycobacterial mycolic acid biosynthetic genes (SEQ ID NOS: 57-58) | Tumor | Fernandes N D et al., *Gene* 170: 95-99 (1996); Mathur M et al., *J. Biol. Chem.* 267: 19388-19395 (1992) |
| 33. c-abl oncogene amplified in chronic myel. Leukemia | Tumor | Scherle P A et al., *Proc. Natl. Acad. Sci.* USA |

TABLE II-continued

Nucleic Acid Constructs and Cells
SAg-encoding DNA is used alone or together with DNA encoding other cell surface
moieties useful in generating antitumor immunity. Genes or their products are shown
in column 1, source information is shown in column 3, preferred cells to be
transformed, transfected or transduced with the DNA are shown in column 2.
All of references are incorporated by reference in their entirety.

| Gene or Gene Product | Cells transformed | Reference or Source |
|---|---|---|
| (SEQ ID NOS: 59-60) | | 87: 1908 (1990); Heisterkamp N et. al., *Nature* 344: 251-253 (1990) |
| 34. erbB2 (HER2/neu) oncogene (SEQ ID NOS: 61-62) | Tumor | Schechter A L et al., *Science* 229: 976 (1985); Bargmann C L *Nature* 319: 226 (1986); Hung M C et al., *Proc. Natl. Acad Sci.* 83: 261 (1986); Yamamoto T et al., *Nature* 319: 230 (1986) |
| 35. IGF-1 receptor gene (SEQ ID NOS: 63-64) | Tumor | Abbott A M et al., *J. Biol. Chem.* 267: 10759-10763 (1992); Scott J et al., *Nature* 317: 260-262 (1985); Liu J et al., *Cell* 75: 59-63 (1993) |
| 36. VEGF (SEQ ID NOS: 65-66) | Tumor | Tischer E et al., *J. Biol. Chem.* 266: 11947-11954 (1991) |
| 37. Strep emm-like gene family | Tumor | Kehoe M A, In: Cell-Wall Associated Proteins in Gram-Positive Bacteria in Bacterial Cell Wall, Ghuysen J M et al., eds, Elsevier, Amsterdam, 1994 |
| 38. iNOS (SEQ ID NOS 67-68) | Tumor | Xie Q W et al., *Science* 256: 225-228 (1992) |
| 39. Apolipoproteins (e.g., Lp(a), apoB-100, apoB-48, apoE) (SEQ ID NOS: 69-74) | Tumor | [See Text] |
| 40. LDL & oxyLDL receptors (e.g., LDL oxyLDL, acetyl-LDL, VLDL, LRP, CD36, SREC, LOX-1, macrophage scavenger receptors) (SEQ ID NOS: 75-86) | Tumor | [See Text] |

6. Superantigens (SAgs)

SAgs are polypeptides that have the ability to stimulate large subsets of T cells. SAgs include Staphylococcal enterotoxins, Streptococcal pyrogenic exotoxins, *Mycoplasma* antigens, rabies antigens, mycobacteria antigens, EB viral antigens, minor lymphocyte stimulating antigen, mammary tumor virus antigen, heat shock proteins, stress peptides, and the like. Any SAg can be used as described herein, although, Staphylococcal enterotoxins such as SEA, SEB, SEC, and SED and streptococcal pyrogenic exotoxins such as toxic shock-associated toxin (TSST-1 also called SEF) are preferred.

When using enterotoxins, the region related to emetic activity can be omitted to minimize toxicity. In addition, SAgs can be derivatized to minimize toxicity. The level of toxicity may not be a concern when using SAg transfected cells to activate lymphocytes ex vivo since the lymphocytes can be rinsed of SAg polypeptide prior to administration to a host.

The nucleic acid sequences that encode SAgs are known and readily available. For example, Staphylococcal enterotoxin A (SEA), SEB, SEC, SED, SEE, TSST-1, and Streptococcal pyrogenic exotoxin (SPEA) have been cloned and can be expressed in *E. coli* (Betley M J and J J Mekalonos, J. Bacteriol. 170:34 (1987); Huang I Y et al., J. Biol. Chem. 262:7006 (1987); Betley M et al., Proc. Natl. Acad. Sci. USA 81:5179 (1984); Gaskill M E and SA Khan, J. Biol. Chem., 263:6276 (1988); Jones C L and SA Khan, J. Bacteriol., 166:29 (1986); Huang I Y and MS Bergdoll, J. Biol. Chem., 245:3518 (1970); Ranelli D M et al., Proc. Nat. Acad. Sci. USA 82:5850 (1985); Bohach G A, Infect Immun., 55:428 (1987); Bohach G A, Mol. Gen. Genet. 209:15 (1987); Couch J L et al., J. Bacteriol. 170:2954 (1988); Kreiswierth B N et al., Nature, 305:709 (1983); Cooney J et al., J. Gen. Microbiol., 134:2179 (1988); Iandolo J J, Annu. Rev. Microbiol., 43:375 (1989); and U.S. Pat. No. 5,705,151)). Additional nucleic acid sequences encoding SAgs are described elsewhere (Bohach et al., Crit. Rev. in Microbiology 17:251-272 (1990); (Kotzin, B L et al., Advances Immunology 54: 99-165 (1993))

PCR can be used to isolate SAg-encoding acid. For example, the nucleic acid encoding SEA, SEB, and TSST-1 can be isolated as described elsewhere (Dow et al., J. Clin. Invest. 99:2616-2624 (1997)). Briefly, the following primers can be used to amplify the SAg-encoding nucleic acid:

```
SEA forward:
GGGAATTCCATGGAGAGTCAACCAG,     (SEQ ID NO: 87)

SEA backward:
GCAAGCTTAACTTGTTAATAG;         (SEQ ID NO: 88)

SEB forward:
GGGAATTCCATGG-AGAAAGCG,        (SEQ ID NO: 89)

SEB backward:
GCGGATCCTCACTTTTTCTTTG;        (SEQ ID NO: 90)
```

-continued

```
TSST-1 forward:
GGGGTACCCCGAAGGAGGAAAAAAAAA      (SEQ ID NO: 91)
TGTCTACAAACGATAATATAAAG, TSST-1 backward:
TGCTCTAGAGCATTAATTAATTTCTGC      (SEQ ID NO: 92)
TTCTATAGTTTTTAT
```

The full-length TSST-1 nucleic acid sequence is cloned into a eukaryotic expression vector (pCR3; InVitrogen Corp., San Diego, Calif.), whereas only the sequence corresponding to the mature SEB and SEA (sequences minus the putative bacterial signal sequences) is cloned into pCR3. Removal of the SEB and SEA signal sequences increases the level of expression in transfected cells. The plasmids are grown in *Escherichia coli* and plasmid DNA extracted by the modified alkaline lysis method and purified on a CsCl gradient.

Nucleic acids encoding mutant or variant SAgs are also considered nucleic acid sequences encoding SAgs within the scope of the invention. For example, a mutant SAg-encoding acid sequence is engineered such that the resulting SAg is devoid of amino acid residues, e.g., histidine, known to produce toxicity Likewise, SAg-encoding nucleic acid is engineered to contain or lack sequences that facilitate the selective binding of SAgs to certain Vβ regions of the TCR present on T cells or to ganglioside, mannose (or other carbohydrate) receptor, certain regions of MHC class II, and/or enterotoxin receptors present on tumor cells, antigen presenting cells (APCs), and/or lymphocytes.

Nucleic acid sequences that encode a SAg are also fused, in frame, with nucleic acid that encodes another polypeptide. This larger nucleic acid is termed herein a SAg fusion gene and the resulting polypeptide product is a SAg fusion product. Nucleic acid sequences that are fused to SAg-encoding nucleic acid include, without limitation, nucleic acid sequences that encode tumor antigens, costimulatory molecules, adhesion molecules and MHC class II molecules. The superantigen fusion product is secreted by a transfected cell, expressed on the cell surface or it may remain intracellular in nucleic acid or partly processed form.

SAgs are also isolated and purified from their natural source as well as from a heterologous expression system such as *E. coli*. Likewise, SAg-containing polypeptides (e.g., SAg fusion products) are isolated and purified from a heterologous expression system. In addition, *Staphylococcus* strains producing high levels of enterotoxin have been identified and are available. For example, exposing enterotoxin-producing *Staphylococcus aureus* to mutagenic agents such as N-methyl-N-nitro-N-nitrosoguanidine results in a 20 fold increase in enterotoxin production over the amounts produced by the parent wild-type *Staphylococcus aureus* strain (Freedman M A and Howard M B J. Bacteriol., 106:289 (1971)).

7. Tumor Cells or Sickled Erythrocytes and Vesicles Expressing SAg and Apolipoproteins Superantigen nucleic acids are fused in frame to nucleic acids encoding apoproteins including but not limited to apoproteins Lp(a), B-48 and 100 and E3 and transfected into tumor cells in vivo to produce tumor cells expressing superantigens and apoproteins. These tumor cells are recognized by apoprotein receptors in tumor microvasculature. Tumor cells are also transfected ex vivo with the identical nucleic acid constructs. A RGD sequence is added to promote deposition in the tumor microvasculature which are useful. These tumor cell transfectants expressing Sag, apoprotein and RGD bind to apoprotein receptors and integrins respectively expressed in tumor microvasculature wherein they initiate a potent and localized anti-tumor response.

Superantigen nucleic acids together with nucleic acids encoding either apo(a), apoB and apoE4 are also transfected into nucleated sickled erythrocytes (e.g., proerythroblast or normoblast phase) by methods given in Examples 1 and 6. The integrin ligand RGD nucleic acids are transfected into tumor cells or sickled cells to facilitate the localization of the transfected tumor cells and sickled cells to integrins expressed in the tumor neovasculature in vivo (see Example 6). Alternatively, the sickled erythrocytes or tumor cells acquire the apolipoprotein or oxyLDL by coculture with liposomes which express the apolipoprotein or oxyLDL (see Section 7 & Example 5).

These tumor cells or sickle cell transfectants are administered parenterally and are capable of trafficking to tumor microvasculature wherein they bind to apolipoprotein and scavenger receptors on endothelial cells and macrophages. The transfectants are phagocytosed by macrophages cells and induce endothelial cell apoptosis. SAgs expressed on the tumor cells and sickle cells also induce a local T cell inflammatory anti-tumor response which envelops the neighboring tumor cells.

These tumor cell and sickle cell constructs are prepared by methods given in Examples 1 and 6 and are useful in vivo against primary and/or metastatic tumors according to Examples 3-7.

8. Functional Homologues & Derivatives of Proteins of Peptides

All of the protein and nucleic acid compositions given herein are intended to encompass functional derivatives. All of the functional derivatives of the fusion partners for superantigens described in this application are encompassed by this invention. Similarly, Staphylococcal enterotoxins or superantigens are intended to encompass functional derivatives of a particular superantigen or enterotoxin.

By "functional derivative" is meant a "fragment," "variant," "homologue," "analogue," "fusion protein," or "chemical derivative", which terms are defined below. A functional derivative retains at least a portion of the function of the native protein monomer which permits its utility in accordance with the present invention.

A "fragment" refers to any shorter peptide. A "variant" of refers to a molecule substantially similar to either the entire protein or a peptide fragment thereof. Variant peptides may be conveniently prepared by direct chemical synthesis of the variant peptide, using methods well-known in the art.

All or the compositions given herein or claimed as part of a new invention include the homologues of that composition. A homologue refers to a natural protein, encoded by a DNA molecule from the same or a protein. Homologues, as used herein, typically share about 50% sequence similarity at the DNA level or about 18% sequence similarity in the amino acid sequence. Homologues are more aptly quantitated in the statistical programs given below. An example a homologue of a native staphylococcal enterotoxin would be any structure including all substitution, deletion or addition mutants, derivatives, fusion proteins, chimeric proteins, fragments, conjugates, synthetic and naturally occurring structures with a Z value >10 in the Lipman-Pearson FASTA/FASTP program.

The recognition that the biologically active regions of the enterotoxins, for example, are substantially structurally homologous enables predicting the sequence of synthetic peptides which exhibit similar biological effects in accordance with this invention (Johnson, L. P. et al., *Mol. Gen. Genet.* 203:354-356 (1886).

A common method for evaluating sequence homology, and more importantly, for identifying statistically significant similarities of the proteins, peptides and nucleic acids given herein is by Monte Carlo analysis using an algorithm written by Lipman and Pearson to obtain a Z value (FASTA). According to this analysis, Z>6 indicates probable significance, and Z>10 is considered to be statistically significant (Pearson, W. R. et. al., *Proc. Natl. Acad Sci. USA*, 85:2444-2448 (1988); Lipman, D. J. et al, *Science* 227:1435-1441 (1985)). Synthetic peptides corresponding to the compositions and enterotoxins and all other molecules described herein are characterized in that they are substantially homologous in amino acid sequence to an enterotoxin or other native molecule to which it is being compared with statistically significant (Z>6) sequence homology and similarity to include alignment of cysteine residues and similar hydropathy profiles.

The Lipman-Pearson FASTA program may be used to determine homology of a given protein using the BLOSUM 50 or PAM 250 scoring matrix, gap penalties of −12 and −2 and the PIR or SwissPROT database. The results are expressed as Z values or E ( ) values. For the present database (2001), the Z>13 indicates statistical significance.

Most deletions and insertions, and substitutions according to the present invention are those which do not produce radical changes in the characteristics of the protein or peptide molecule. However, when it is difficult to predict the exact effect of the substitution, deletion, or insertion in advance of doing so, one skilled in the art will appreciate that the effect will be evaluated by routine screening assays, for example direct or competitive immunoassay or biological assay as described herein. Modifications of such proteins or peptide properties as redox or thermal stability, hydro-phobicity, susceptibility to proteolytic degradation or the tendency to aggregate with carriers or into multimers are assayed by methods well known to the ordinarily skilled artisan.

In the present invention, functional derivatives or homologues of proteins, peptides, enterotoxins or other related toxins and nucleic acids including fusion proteins, mutants (deletion and addition types), variants, conjugates with other proteins including but not limited to antibodies, $F(ab')_2$, Fv or Fd fragments, receptors or receptor ligands, synthetic polypeptides and nucleic acids characterized by substantial structural homology to staphylococcal enterotoxin A, enterotoxin B, enterotoxin C, enterotoxin D, enterotoxin E, enterotoxin F (TSST-1) and Streptococcal pyrogenic exotoxins A-H as well as the newer enterotoxins (SEG, SEH, SEI, SEJ, SEK, SEL, SEM), SETs 1-5 and non-enterotoxin superantigens (e.g., *Yersinia pseudotuberculosis* superantigen, *Mycoplasma arthitidis* superantigen) with statistically significant sequence homology and similarity (e.g., Z>6 in the Lipman and Pearson algorithm in Monte Carlo analysis (FASTA program) or the preferred methodology for determining sequence similarity and identity of proteins and nucleic acid as given above in this section (e.g., ALIGN, NBLAST, XBLAST programs as described above) are included in the invention. All of the superantigen conjugates to other polypeptides, peptides (e.g., verotoxins, chemokine receptors, costimulants, invasins, viral antigens) given in this application are considered to be structural homologues are included in this invention as structural homologues if they show Z values >10 or additional statistical criteria for inclusion as given in this section.

9. New Streptococcal Pyrogenic Exotoxins, Staphylococcal Enterotoxins and SETs for Tumor Therapy Streptococcal pyrogenic exotoxins SPEA, SPEB, SPEC, SPEC, SPEH, SPEH SME-Z, SME-$Z_2$ and SSA are superantigens induce tumoricidal effects. SPEG, SPEH, and SPEJ genes were identified from the *Streptococcus pyogenes* Ml genomic database at the University of Oklahoma. A fourth novel gene (smez-2) was isolated from the *S. pyogenes* strain 2035, based on sequence homology to the streptococcal mitogenic exotoxin z (smez) gene. SMEZ-2, SPE-G, and SPE-J are most closely related to SMEZ and streptococcal pyrogenic exotoxin (SPE)-C, whereas SPE-His most similar to the staphylococcal toxins than to any other streptococcal toxin. Recombinant (r)SMEZ, rSMEZ-2, rSPE-G, and rSPE-H were mitogenic for human peripheral blood lymphocytes. SMEZ-2 is the most potent superantigen (SAg) discovered thus far. All toxins, except rSPE-G, were active on murine T cells, but with reduced potency. Binding to a human B-lymphoblastoid line was shown to be zinc dependent with high binding affinity of 15-65 nM. Evidence from modeled protein structures and competitive binding experiments suggest that high affinity binding of each toxin is to the major histocompatibility complex class II (3 chain. Competition for binding between toxins was varied and revealed overlapping but discrete binding to subsets of class II molecules in the hierarchical order (SMEZ, SPE-C)>SMEZ-2>SPE-H>SPE-G. The most common targets for these SAgs were human Vβ 2.1- and Vβ4-expressing T cells.

There are four naturally occurring SPEA alleles, and three of these, SPEA1, SPEA2, and SPEA3, encode toxins differing by a single amino acid. The toxin encoded by SPEA4 is 9% divergent from the other three, with 26 amino acid changes. Twenty mutant forms of SPEA1 (SPEA encoded by allele 1), and the mutant toxins were analyzed for mitogenic stimulation of human peripheral blood mononuclear cells, affinity for class II major histocompatibility complex molecules (DQ), and disulfide bond formation. Residues necessary for each of these functions were Identified., The product of allele 2, SPEA2, had slightly higher affinity for the class II MHC molecule compared with SPEA1 but not significantly greater mitogenic activity. SPEA3, however, was significantly increased in mitogenic activity and affinity for class II MHC compared with SPEA1. Thus, there is evidence that the toxin encoded by some of the highly virulent *S. pyogenes* STSS-associated isolates is a more active form of SPEA.

A new ~28-kDa superantigen protein designated streptococcal superantigen (SSA), was isolated from culture supernatants. SSA stimulated proliferation of human T cells bearing Vβ1, Vβ3, Vβ5.2, and Vβ15 in an MHC class II-dependent manner. N-terminal sequencing found the first 24 residues of SSA to be 62.5% identical to staphylococcal superantigens SEB, SEC1, and SEC3.

Newer Staphylococcal enterotoxins SEG, SEH, SEI, SEJ, SEK, SEL, SEM, ENT, ENT1, ENT2, also show superantigenic activity and are capable of inducing tumoricidal effects. The homology of these toxins to other toxins in the family ranges from 27-64%. Selective expansion of TCR Vβ subsets has been demonstrated for each. (Jarraud S et al., *J. Immunol.* 166: 669-677 (2001); Jarraud S et al., *J. Clin. Microbiol.* 37: 2446-2449 (1999); Munson, S H et al., *Infect. Immun.* 66:3337-3345 (1998 The above streptococcal and newer enterotoxins retain T cell activation and Vβ usage. SPEA, SPEC, SPEG, SPEH, SME-Z, SME-$Z_2$, SEG, SEH, are known to utilize zinc as part of high affinity MHC class II receptor. Amino acid substitution(s) at the high affinity zinc dependent class II binding site is used to reduce their affinity for MHC class II receptor. Tumor localization is insured by the fusion with tumor specific antibodies, $F(ab')_2$ or single chain Fv fragments. Additional or alternative tumor localizing motifs may be added to the toxin molecules which include but are not limited to an RGD motif, VEGF (localizing to KDR tyrosine kinase receptors on vascular endothelium) and other tumor receptor ligands.

These proteins and their homologues are isolated and characterized as in Example 10 and. These proteins and their homologues are useful as preventative or therapeutic antitumor vaccines according to Examples 5 and 6 and in nucleic acid form as in Example 1.

10. Coaguligands: SEs Fused to Coagulation Factors

Superantigens may be conjugated to, or operatively associated with, polypeptides that are capable of directly or indirectly stimulating coagulation, thus forming a "coaguligand" (Barinaga M et al, *Science* 275:482-4 (1997); Huang X et al, *Science* 275:547-50 (1997); Ran S et al, *Cancer Res Oct.* 15 1998; 58(20):4646-53; Gottstein C et al., *Biotechniques* 30:190-4 (2001)).

In coaguligands, the antibody may be directly linked to a direct or indirect coagulation factor, or may be linked to a second binding region that binds and then releases a direct or indirect coagulation factor. The 'second binding region' approach generally uses a coagulant-binding antibody as a second binding region, thus resulting in a bispecific antibody construct. The preparation and use of bispecific antibodies in general is well known in the art, and is further disclosed herein.

Coaguligands are prepared by recombinant expression. The nucleic acid sequences encoding the SAg are linked, in-frame, to nucleic acid sequences encoding the chosen coagulant, to create an expression unit or vector. Recombinant expression results in translation of the new nucleic acid, to yield the desired protein product.

Where coagulation factors are used in connection with the present invention, any covalent linkage to the SAg should be made at a site distinct from the functional coagulating site. The compositions are thus "linked" in any operative manner that allows each region to perform its intended function without significant impairment. Thus, the SAg binds to and stimulates T cells, and the coagulation factor promotes blood clotting.

Preferred coagulation factors are Tissue Factor ("TF") compositions, such as truncated TF (tTF), dimeric, multimeric and mutant TF molecules. "Truncated TF" (tTF) refers to TF constructs that are rendered membrane-binding deficient by removal of sufficient amino acid sequences to effect this change in property. A "sufficient amount" in this context is an amount of transmembrane amino acid sequence originally sufficient to enter the TF molecule in the membrane, or otherwise mediate functional membrane binding of the TF protein. The removal of such a "sufficient amount of transmembrane spanning sequence" therefore creates a truncated TF protein or polypeptide deficient in phospholipid membrane binding capacity, such that the protein is substantially a soluble protein that does not significantly bind to phospholipid membranes. Truncated TF thus substantially fails to convert Factor VII to Factor Vila in a standard TF assay, and yet retains so-called catalytic activity including activating Factor X in the presence of Factor Vila.

U.S. Pat. No. 5,504,067 is specifically incorporated herein by reference describes truncated TF proteins. Preferably, the TFs for use herein will generally lack the transmembrane and cytosolic regions (amino acids 220-263) of the protein. However, there is no need for the truncated TF molecules to be limited to molecules of the exact length of 219 amino acids.

Any of the truncated, mutated or other TF constructs maybe prepared in a dimeric form. TF dimers are prepared by employing the standard techniques of molecular biology and recombinant expression, in which two coding regions are prepared in-frame and expressed from an expression vector. Equally, various chemical conjugation technologies may be employed to prepare TF dimers. The individual TF monomers may be derivatized prior to conjugation.

The tTF constructs may be multimeric or polymeric. A "polymeric construct" contains 3 or more Tissue Factor constructs. A "multimeric or polymeric TF construct" is a construct that comprises a first TF molecule or derivative operatively attached to at least a second and a third TF molecule or derivative. The multimers may comprise between about 3 and about 20 such TF molecules. The constructs may be readily made using either recombinant manipulation and expression or using standard synthetic chemistry.

TF mutants deficient in the ability to activate Factor VII are useful. Such "Factor VII activation mutants" are generally defined herein as TF mutants that bind functional Factor VH/VIIa, proteolytically activate Factor X, but are substantially free from the ability to proteolytically activate Factor VII. Accordingly, such constructs are TF mutants that lack Factor VII activation activity.

The ability of such Factor VII activation mutants to function in promoting tumor-specific coagulation is based upon their specific delivery to the tumor vasculature, and the presence of Factor Vila at low levels in plasma. Upon administration of such a Factor VII activation mutant conjugate, the mutant will be localized within the vasculature of a vascularized tumor. Prior to localization, the TF mutant would be generally unable to promote coagulation in any other body sites, on the basis of its inability to convert Factor VII to Factor VIIa. However, upon localization and accumulation within the tumor region, the mutant will then encounter sufficient Factor Vila from the plasma in order to initiate the extrinsic coagulation pathway, leading to tumor-specific thrombosis. Exogenous Factor VIIa could also be administered to the patient.

Any one or more of a variety of Factor VII activation mutants may be prepared and used in connection with the present invention. The Factor VII activation region generally lies between about amino acid 157 and about amino acid 167 of the TF molecule. Residues outside this region may also prove to be relevant to the Factor VII activating activity. Mutations are inserted into any one or more of the residues generally located between about amino acid 106 and about amino acid 209 of the TF sequence (WO 94/07515; WO 94/28017; each incorporated herein by reference).

A variety of other coagulation factors may be used in connection with the present invention, as exemplified by the agents set forth below. Thrombin, Factor V/Va and derivatives, Factor VHI/VIIIa and derivatives, Factor IX/IXa and derivatives, Factor X/Xa and derivatives, Factor Xl/XIa and derivatives, Factor XH/XIIa and derivatives, Factor XIll/XIIIa and derivatives, Factor X activator and Factor V activator may be used in the present invention.

11. Chemotherapeutic Agents

A variety of chemotherapeutic agents may be used in the combined treatment methods disclosed herein. Chemotherapeutic agents contemplated as exemplary include, e.g., cisplatin (CDDP), adriamycin, actinomycin, mitomycin, caminomycin, daunomycin, doxorubicin, tamoxifen, taxol, taxotere, vincristine, vinblastine, vinorelbine, etoposide (VP-16), 5-fluorouracil (5FU), cytosine arabinoside, cyclophosphamide, thiotepa, methotrexate, campothecin, actinomycin-D, mitomycin C, aminopterin, combretastatin(s) and derivatives and prodrugs thereof. Anti-cancer chemotherapeutic drugs useful in this invention include but are not limited to antimetabolites, anthracycline, vinca alkaloid, anti-tubulin drug, antibiotic, alkylating agent The chemotherapeutic agent(s)

selected for use preferably shows the highest response rate against tumor to be treated. For example, in non-small cell lung cancer, the cisplatin-based trials showed a benefit of chemotherapy with a hazard ratio of 0.73 (p<0.0001), equivalent to an absolute improvement in survival of 10% (5-15%) at 1 year, or an increase in median survival of 1½ months (1-2½ months). Completed prospective randomized trials including quality-of-life analyses show that cisplatin-based therapeutic regimens also improve quality of life in these patients. Other agents in phase III trials in patients with advanced NSCLC include the taxanes (paclitaxel and docetaxel), vinca alkaloid (vinorelbine), antimetabolite (gemcitabine), and campothecin (irinotecan). These agents have shown promise in both phase I and II trials, both as single agents and in combination with a platinum agent.

EXAMPLES

Example 1

Preparation of Plasmids for Making DNA Templates for any Gene of Interest and the Process of Transfection Mammalian oncogenes, and genes for oncogenic transcription factors, angiogenic factors, growth factor receptors and amplicons as well as bacterial and SAg plasmids and DNA are prepared as described in the text references. When necessary, they are modified to forms suitable for transfection into mammalian tumor cells or accessory cells using methods well described in the art. (Old R W et al., Principles of Gene Manipulation, 5th Ed., Blackwell 1994).

As a representative SAg, enterotoxin B plasmid DNA is prepared by the method of Jones C L et al., J. Bacteriology 166 29-33 (1986) and Ranelli et al., Proc. Natl. Acad. Sci. USA 82:5850-5854 (1985) using the CsCl-ethidium bromide density gradient centrifugation of cleared lysates as described (Clewell, D B et al., Proc. Natl. Acad. Sci. USA 62-1159-1166 (1969)). *S. aureus* chromosomal DNA was isolated as described by Betley M et al., Proc. Natl. Acad. Sci. USA 81: 5179-5183 (1984). *E. coli* HB101 was transformed with plasmid DNA by the $CaCl_2$ procedure of Morrison D A et al., Meth. Enzymol. 68:326-331 (1979). Restriction digests were analyzed by 1% agarose and 5% acrylamide gel electrophoresis using Tris/Borate/EDTA buffer as described in Greene P J et al., Methods Mol. Biol. 7: 87-111 (1974). Additional methods for isolation and cloning of specific bacterial and mammalian plasmid DNA useful in tumor or accessory cell transfection are cited in references given previously in the text or in Snyder L et al., Molecular Genetics of Bacteria, ASM Press, Washington, D.C. (1997); Peters et al., supra; Franks et al., supra.

Suitable template DNA for production of mRNA encoding a desired polypeptide may be prepared using standard recombinant DNA methodology as described in Ausubel F et al. Short Protocols in Molecular Biology 3rd Ed. John Wiley, New York, N.Y. (1995). There are numerous available cloning vectors and any cDNA containing an initiation codon can be introduced into the selected plasmid and mRNA can be prepared from the resulting template DNA. The plasmid can be cut with an appropriate restriction enzyme to insert any desired cDNA coding for a polypeptide of interest. For example the readily available cloning vector pSP64T can be used after linearization and transcription with SP6 RNA polymerase. Smaller sequence may be inserted into the Hind III/EcoTI fragment with T4 ligase. Resulting plasmids are screened for orientation and transformed into *E. coli*. These plasmids are adapted to receive any gene of interest at a unique BglII restriction site which is placed between the two *Xenopus* β-globin sequences.

Subcloning of SEB into pHb-Apr-1-Neo Expression Vector:

The Staphylococcal enterotoxin B (SEB) gene has been subcloned into pHβ-Apr-1-neo expression vector. The final construct contained only the coding sequence of SEB and conferred resistance to ampicillin and G-418.

Materials and Methods

PCR:

1. The following two primers are designed and made at Life Technologies, Inc.:

```
Primer SEB1: total 24 bp
5' to 3' GGC.GTC.GAC.ATG.TAT.AAG.AGA.TTA
```

SalI site:

```
Primer SEB2: total 24 bp
5' to 3' GCC.GGA.TCC.TCA.CTT.TTT.CTT.TGT
```

BamHI site:

Both primers were dissolved in filter-sterilized $ddH_2O$ to a final concentration of 20 mM (stock solution).

2. The volume (in ml) of reagents for each PCR reaction is listed below:

| Reagent | Exp. 1 | Exp. 2 | Exp. 3 | Exp. 4 | Exp. 5 |
|---|---|---|---|---|---|
| $ddH_2O$ | 76 | 72 | 67 | 49 | 59 |
| 10 X PCR buffer | 10 | 10 | 10 | 10 | 10 |
| 10 X dNTP (2 mM stock) | 10 | 10 | 10 | 10 | 10 |
| Primer SEB1 (20 mM stock) | 1 | 5 | 1 | 10 | 10 |
| Primer SEB2 (20 mM stock) | 1 | 1 | 1 | 10 | 10 |
| SEB Template (50 mg stock) | 1 | 1 | 10 | 10 | 0 |
| PfuTurbo Enz | 1 | 1 | 1 | 1 | 1 |
| Final Volume | 100 | 100 | 100 | 100 | 100 |

3. The following cycling parameters were applied:

| | | |
|---|---|---|
| 95° C. | 1 minute | 1 cycle initial denature |
| 95° C. | 45 seconds | denature |
| 52° C. | 1 minute | 20 cycles anneal |
| 72° C. | 1 minute | extension |
| 72° C. | 1 minute | 1 cycle final extension |
| 4° C. | hold | |

4. To verify that the PCR reactions yielded the correct size fragment, 10 ml of the reaction mixture was electrophoresed on a 1% agarose gel in 1×TAE buffer.

Vector:

1. The pHb-Apr-1-neo expression vector was spotted on a filter paper.

2. To recover the DNA, the circle was cut out and added to 100 ml of $H_2O$ to allow rehydration for 5 minutes. After a brief centrifugation, the supernatant was used to transform *E. coli* XL1Blue (Stratagene), and selected by ampicillin (final concentration 100 mg/ml).

3. To verify that the vector is correct, 4 ampR clones were randomly selected and the clones were cultured in LB amp media. DNA was isolated and digested with SalI, BamHI (single digest) and EcoRI/HindIII (double digest). The digested products were electrophoresed on a 1% agarose gel in 1×TAE buffer. The profile of the restriction digest confirmed that the vector is correct.

Cloning and Verification:

1. The correct PCR fragments in experiments 2, 3, and 4 were pooled and gel-purified. A portion of the fragments was digested with restriction enzymes SalI and BamHI, and was ligated into the digested pHb-Apr-1-neo expression vector. The ligation products were transformed into *E. coli* XL1Blue (Stratagene). Insert containing clones were selected by ampicillin.

2. Ten ampicillin resistant clones were randomly selected, cultured in 5 ml of LB amp media, and their plasmid DNA was isolated. Insert containing clones (SEB construct were verified by digesting the DNA with SalI and BamHI restriction endonucleases and electrophoresis at 0.8% agarose gel.

3. One of the SEB constructs (clone #2) was verified by sequencing and aligned with the published SEB sequence. Purified DNA templates from bacteria and human cells are prepared for introduction of plasmid into human and bacterial cells by additional methods given in Ausubel F et al., supra. The plasmid DNA is grown up in *E. coli* in ampicillin containing LB medium. The cells were then pelleted by spinning a 5000 rpm for 10 min. at 5000 rpm., resuspended in cold TE pH 8.0, centrifuged again for 10 minutes. at 5000 rpm., resuspended in a solution of 50 mM glucose, 25 mM Tris-Cl pH 8.0, 10 mM EDTA and 40 mg/ml lysozyme. After incubation for 5-10 min. with occasional inversion, 0.2 N NaOH containing 1% SDS was added, followed after 10 minutes at 0° C. with 3 M potassium acetate and 2 M acetic acid. After 10 more minutes, the material was again centrifuged a 6000 rpm, and the supernatant was removed with a pipet. The pellet was then mixed into 0.6 vol. isopropanol (−20° C.), mixed, and stored at −20° C. for 15 minutes. The material was then centrifuged again at 10,000 rpm for 20 min., this time in an HB4 singing bucket rotor apparatus after which the supernatant was removed and the pellet was washed in 70% EtOH and dried at room temperature. Next, the pellet was resuspended in 3.5 ml TE, followed by addition of 3.4 g CsCl and 3501 of 5 mg/ml EtBr. The resulting material was placed in a quick seal tube, filled to the top with mineral oil. The tube was spun for 3.5 hours at 80,000 rpm in a VTi80 centrifuge. The band was removed and the material was centrifuged again making up the volume with 0.95 g CsCl/ml and 0.1 ml or 5 mg/ml EtBr/ml in TE. The EtBr was then extracted with an equal volume of TE saturated N-Butanol after adding 3 volumes of TE to the band. Next, 2.5 vol. EtOH was added, and the material was precipitated at −20° C. for 2 hours. The resultant DNA precipitate is used as a DNA template.

Transfection of B16F10 Melanoma Cells:

G418 sensitivity: B16F10 melanoma cells (B16s) were first tested for sensitivity to G418 which will be used as the selectable marker. At 400 ug/mL G418, B16s did not survive, while 200 and 300 ug/mL allowed some survival.

Transfection:

Lipofectamine was used to produce stably transfected B16s. The conditions for transfection were those described protocol provided by Life Technologies. B16s were plated at $4\times10^5$ cells/well in 6 well plates, using Murine Complete Medium (MCM) described in Report 2. Cells were cultured overnight. Optimal density is 50-80% confluent and is usually achieved by 18-24 after seeding at 1-3×105 cells/well. DNA sources consisted of SEB-G418 resistance containing vector, vector DNA with G418 resistance gene only, and control DNA from PSK401 (no G418 resistance marker). DNA concentrations were determined for the SEB containing and control vectors.

| DNA source | A260 | DNA (ug/ml) |
|---|---|---|
| SEB | 0.09 | 0.45 |
| Vector only | 0.13 | 0.65 |
| PSK 401 | 0.15 | 0.75 |

Lipofectamine solutions and DNA solutions were prepared in 12×75 mm tubes, using OPTI-MEM (Life Technologies 31985). DNA solutions contained approximately 2 ug in 100 uL OPTI-MEM; the LIPOFECTAMINE Reagent was diluted by adding 6 or 12 uL to OPTI-MEM at a final volume of 100 uL. The solutions were mixed and held at room temperature for 30 minutes. Specific DNA and Lipofectamine conditions were as follows:

Plated cells were rinsed once with 2 ml/well OPTI-MEM. To the above tubes, 0.8 mL OPTI-MEM. This mixture was then overlayed onto the washed cell monolayers according to the above well designations. Cells were incubated for 5 hours at 37° C. in 5% CO2. Murine Complete Medium with 20% FBS but no antibiotics was then added at 1 ml/well. Cultures were refed with standard MCM, at 3 mL/well, after 24 hours. Three days after transfection, cells from each transfection condition were subcultured by splitting the total cell suspension 90:10 into 150 mm plates (one plate received 90% of the cell suspension, the other received the remaining 10%).

G418 Selection:

All plates were refed at 6 days after transfection with medium containing 400 ug/mL G418. Plates were refed every 2 to 3 days with G418 containing medium until day 17 after transfection. No growth was observed in wells 1-4 as expected. Plates initiated with 90% of the cell suspension and showing growth were harvested, frozen, and stored at −80° C.

Primary Subcloning:

Ten colonies were selected from each well for wells 5, 7, 9, and 11. Subcloning was accomplished by the use of cloning cylinders as follows: After seating the cylinder, medium was aspirated and the isolated colony was washed once with 100 uL of warmed trypsin-EDTA. This was aspirated and replaced with fresh tyrpsin-EDTA. After incubation at 37° C. for 2 minutes, the cells were recovered by centrifugation and transferred to a tube containing 1 ml MCM, then replated by addition of 20 uL of cell suspension to 15 mL MCM with G418 in 150 mm plates. The remaining cell suspension was plated into 24 well plates, 4 wells/clone and all plates were maintained at 37° C., 5% CO2. The 6 well plates were used to assess SEB expression on the cell surface as described under Detection of positive clones.

Secondary and Tertiary Subcloning and Preparation of Frozen Stocks:

These and all subsequent procedures were performed by me. Secondary subcloning was performed as above at 7 days after initiation of primary subclones. One colony/plate was selected for further subcloning (a total of 40 colonies). The cell suspension was prepared in a total volume of 1 mL; 100 uL was replated into 100 mm plates containing 10 mL MCM with G418. The remaining cell suspension was plated in 96 well plates at 100/well, 2 replicates for assay. The 96 well plate was used for detection of intracellular expression of SEB described under Detection of positive clones.

Primary subcloning plates were cultured one additional day, then harvested, frozen, and stored at −80° C. These frozen stocks are designated primary subclones. Secondary subclones were refed after 4 days. Of 40 secondary clones, 36 regrew. Tertiary subcloning was performed after 8 days and frozen stocks of secondary clones were prepared after 9 days.

Tertiary clones were refed after 3 days in culture and subcultured after 7 days in culture. Plates were harvested, cells were resuspended in a total of 1 mL, and replated by addition of 100 μL of the cell suspension to 100 mm plates with 15 mL MCM or 100 μL/well in a 96 well plate. Frozen stocks of tertiary clones were prepared.

Generation of Conditioned Medium for Assay of Supernatants:

After 7 days, 100 mm plates of tertiary clones were again replated. This time, cell counts were performed and $4.5\times10^5$ cells were plated in 12 well plates, one well/clone. The remaining cell suspension was frozen and stored at −80° C. After 4 days in culture, supernatants were harvested, stored at 4° C., and the cells were replated into 100 mm plates. Supernatants were obtained from the 100 mm plates after 7 days in culture. Frozen stocks were also generated from these plates.

Development of ELISA with HRP Rabbit Anti-SEB

Final ELISA conditions were as follows:

| | |
|---|---|
| Assay Plate | ProBind (Falcon #3915) |
| Capture Antibody | Rabbit anti-SEB (Toxin Technologies # LBI202), 10 ug/mL in PBS, 50 uL/well, 1 hr, RT |
| Wash | 3X with 0.1% casein, 0.1% Tween 20 in PBS |
| Blocking | 1% casein in PBS, 250 uL/well, overnight, 4° C. |
| Antigen | Supernatant used neat or SEB diluted in PBS, 50 μL/well, 2 hr, RT |
| Wash | As above |
| Primary Ab | HRP Rabbit anti-SEB (Toxin Technologies # LBC202), 1/300 in block buffer, 50 μL/well, 2 hr, RT |
| Substrate | OPD, 2.5 mg/mL in citrate buffer, pH 5.0, 0.03% $H_20_2$, 100 μl/well, 15 min, RT |
| Stop | 4 M H2SO4, 100 μL/well |
| Read-out | OD 490 nm |

Results: SEB produced a dose response curve (linear range 60 fg-60 pg/mL) and the background was very low. Vector only clones produced only background signals. One SEB transfected clone produced a strong signal, three produced moderate signals, and one other produced a weak but definite signal.

| | OD 490 nm | | | | | |
|---|---|---|---|---|---|---|
| | SEB+ | | | Vector only | | |
| | 1 | 2 | mean | 1 | 2 | mean |
| 9.1 | 0.097 | 0.112 | 0.104 | 0.079 | 0.102 | 0.091 |
| 9.2 | 0.127 | 0.123 | 0.125 | 0.081 | 0.076 | 0.078 |
| 9.3 | 0.109 | 0.104 | 0.106 | 0.087 | 0.070 | 0.079 |
| 9.4 | 0.444 | 0.393 | 0.418 | 0.077 | 0.077 | 0.077 |
| 9.5 | 0.163 | 0.087 | 0.125 | 0.075 | 0.074 | 0.074 |
| 9.6 | 0.516 | 0.522 | 0.519 | 0.066 | 0.064 | 0.065 |
| 9.7 | 0.087 | 0.091 | 0.089 | 0.096 | 0.084 | 0.090 |
| 9.8 | 0.386 | 0.450 | 0.418 | 0.080 | 0.071 | 0.075 |
| 9.9 | 0.137 | 0.122 | 0.130 | 0.071 | 0.070 | 0.071 |
| 11.1 | 0.083 | 0.075 | 0.079 | 0.068 | 0.078 | 0.073 |
| 11.2 | 1.847 | 1.802 | 1.824 | 0.063 | 0.076 | 0.070 |
| 11.3 | 0.071 | 0.077 | 0.074 | 0.076 | 0.074 | 0.075 |
| 11.4 | 0.087 | 0.084 | 0.086 | 0.083 | 0.085 | 0.084 |
| 11.5 | 0.161 | 0.220 | 0.191 | 0.092 | 0.086 | 0.089 |
| 11.8 | 0.221 | 0.100 | 0.160 | 0.080 | 0.081 | 0.080 |
| 11.9 | 0.080 | 0.091 | 0.085 | 0.077 | 0.072 | 0.074 |
| 11.10 | 0.290 | 0.254 | 0.272 | 0.081 | 0.112 | 0.097 |
| 11.10 | 0.268 | 0.263 | 0.265 | 0.093 | 0.114 | 0.103 |

Based on the SEB standard curve, the following concentrations were derived.

| Clone number (pg/ml) | SEB |
|---|---|
| 11.2 | 4.146 |
| 9.6 | 0.152 |
| 9.4 | 0.118 |
| 9.8 | 0.118 |
| 11.10 | 0.081 |

Cells are transfected ex vivo or in vivo and implanted in a cancer-bearing host. These transfected cells are also used to stimulate host lymphocytes ex vivo. Once activated, the lymphocytes are administered to the host. The ex vivo or in vitro introduction of DNA into cells is accomplished by methods that (1) form DNA precipitates which are internalized by the target cell; (2) create DNA-containing complexes with charge characteristics that are compatible with DNA uptake by a target cell; or (3) result in the transient formation of pores in the plasma membrane of a target cell exposed to an electric pulse (these pores are of sufficient size to allow DNA to enter the target cell).

Generally, two factors determine the method used: the duration of expression required (i.e., transient versus stable expression) and the type of cell to be transfected. The specific details of exemplary procedures are described herein. Transfections are carried out by well established methods including calcium phosphate precipitations, DEAE Dextran transfection, and electroporation.

Calcium Phosphate Precipitation

A commonly used ex vivo and in vitro method to transfer DNA into recipient cells involves the co-precipitation of the DNA of interest with calcium phosphate. With this technique, DNA enters the cell in sufficient quantities such that the treated cells are transformed with relatively high frequency. Using a variety of cell types, transfection efficiencies of up to 10-3 have been obtained. This is the method of choice for the generation of stable transfectants.

Variations of the basic technique have been developed. If the transfection involves the transfer of plasmid DNA, then high molecular weight genomic DNA isolated from a defined cell or tissue source can be included. The addition of such DNA, called carrier DNA, often increases the efficiency of transfection by the plasmid DNA. Upon arrival of the plasmid DNA/carrier DNA/calcium phosphate co-precipitate to the nucleus of the treated cell, the plasmid DNA integrates into the carrier DNA, often in the tandem array, and this assembly of plasmid and carrier DNA, called a transgenome, subsequently integrates into the chromosome of the host cell.

Another procedural option is the addition of a chemical shock step to the transfection protocol. Either dimethylsulfoxide or glycerol are appropriate. The optimal concentrations and lengths of treatment vary according to cell type. The use of these agents dramatically affect cell viability and can be optimized as described elsewhere [Chen and Okayama, *Mol. Cell. Biol.* 7:2745 (1987)]. Specifically, incubation of cells with the co-precipitate is optimal at 35° C. in 2-4% $CO_2$ for 15-24 hours. In addition, circular DNA is more active than linear DNA and a finer precipitate is obtained when the DNA concentration is between 20-30 mg/ml in the precipitation mix.

It is noted that incubator temperature, $CO_2$ concentration, and DNA concentration can be varied to obtain the desired result. In addition, the temperature and $CO_2$ concentrations described below are not optimal for cell growth and should be maintained only temporarily.

Method:
Day 1: 1.3×10⁶ cells are seeded per 100-mm dish. Cells are about 75% confluent when used to seed the dishes.
Day 2: A large calcium phosphate cocktail mixture to transfect many plates simultaneously is prepared. This protocol is given for 1 ml (or 1×100-mm dish equivalent) of solution. These amounts are scaled up as necessary, allowing for an appropriate amount of sample-transfer errors. Adherence to sterile technique is critical. Sterile reagents, tips, and tubes are used.
1. Add 1-20 g DNA (1 mg/ml in sterile TE, 10 mM Tris-HCl 1 mM EDTA pH 7.05) to 0.45 ml sterile $H_2O$, Note: First "sterilize" DNA by ethanol precipitation with NaCl (0.1M final aqueous concentration) and 2× volume 200% ethanol.
2. Add 0.5 ml 2×HEPES buffered saline. Mix well.
3. Add 50 ml of 2.5 M $CaCl_2$, vortex immediately.
4. Allow the DNA mixture to sit undisturbed for 15-30 minutes at room temperature.
5. Add 1 ml of the DNA transfection cocktail directly to the medium in the 100-mm dish (plated with cells on day 1).
6. Incubate the dishes containing the DNA precipitate for 16 hours at 37° C. Remove the media containing the precipitate and add fresh complete growth media.
7. Allow the cells to incubate for 24 hours. Post-incubation, the cultures can be split for subsequent selection. Split cultures 1:5; however, to isolate individual colonies for further analysis, split cultures 1:10 and 1:100.

DEAE Dextran Transfection

Typically, DEAE dextran transfection is used to transiently transfect cells in culture. This method is highly efficient and the DNA/DEAE dextran mixture used for transfection is relatively easy to prepare. For example, this method yields transfection efficiencies of as high as 80 percent. DNA introduced into cells with this method, however, appears to undergo mutations at a higher rate than that observed with calcium phosphate-mediated transfection.
Method:
Briefly, a DEAE dextran mixture is prepared and the DNA sample of interest is added, mixed, and then transferred to the cells in culture.
Day 1: Cells are seeded at a concentration of 2×10⁴ cells/cm2 in a total volume of 2 ml/well (1.92×10⁵ cells/well of a six-well cluster dish). Cells should be about 75% confluent when used to seed the dishes.
Day 2: Resuspend 0.5 ml DEAE Dextran in Tris-buffered saline (TBS). Final DEAE Dextran concentration should be about 0.04%. Observe cell monolayers microscopically. Cells should appear about 60-70% confluent and well distributed. Bring all reagents to room temperature. Aspirate off growth media and wash monolayer once with 3 ml of phosphate buffered saline (PBS), followed by one wash with 3 ml of TBS. Aspirate off TBS solution and add 100-125 ml of the appropriate DNA/DEAE-Dextran/TBS mixture to the wells. Incubate dishes at room temperature inside a laminar flow hood. Rock the dishes every 5 minutes for 1 hour, making sure the DNA solution covers the cells. After the 1-hour incubation period, aspirate off the DNA solution and wash once with 3 ml of TBS followed by 3 ml of PBS. Remove the PBS solution by aspiration and replace with 2 ml of complete growth media containing 100 M chloroquine. Incubate the dishes in an incubator set at 37° C. and 5% $CO_2$ for 4 hours. Remove the media containing chloroquine and replace with 2-3 ml of complete growth media (no chloroquine). Incubate the transfected cells for 1-3 days, after which the cells will be ready for analysis. The exact incubation period depends on the intent of the transfection. Optimal expression typically occurs at 3 days post-transfection.

Electroporation

Electroporation is a process whereby cells in suspension are mixed with the DNA to be transferred. This cell/DNA mixture is subsequently exposed to a high-voltage electric field. This creates pores in the membranes of treated cells that are large enough to allow the passage of macromolecules such as DNA into the cells. Such DNA molecules are ultimately transported to the nucleus and a subset of these molecules are integrated into the host genome. The reclosing of the membrane pores is both time and temperature dependent and thus is delayed by incubation at 0° C., thereby increasing the probability that the molecule of interest will enter the cell.

Electroporation appears to work on virtually every cell type. With this technique, the efficiency of nucleic acid transfer is high for both transient transfection and stable transfection. One important technical difference between electroporation and other competing technologies is that the number of input cells required for electroporation is considerably higher.
Method:
1. Harvest exponentially growing cells such as tumor cells or accessory cells by trypsinization, pellet, and wash twice with electroporation buffer (Kriegler, M. Gene Transfer and Expression, W.H. Freeman and Co., New York, N.Y. (1991)).
2. Resuspend cells in electroporation buffer at a concentration of 2-20×10⁶ cells/ml in an electroporation cuvette.
3. Add 5-25 mg of DNA that has been linearized to the cell suspension
4. Insert or connect the electroporation electrode according to the manufacturer's instructions and subject cell/DNA mixture to an electric field (pulse).
5. Return cell/DNA mixture to ice and incubate for 5 minutes.
6. Plate cells in non-selective medium. Biochemical selection may be carried out 24-48 hours later.

Lipofectamine

In vitro cell transfections can be done in 12-well plates, using 3.0 g plasmid DNA and Lipofectamine (GIBCO BRL), at 37° C. for 4 hours. After transfection, the cells are cultured in 2.0 ml complete medium for 48 hours and the cells are harvested. The cells are then washed in PBS. Stably transfected Chinese hamster ovary (CHO) and B16 lines are isolated by selection in 1.0 mg/ml G418 (GIBCO BRL). Cells are grown and passaged in medium containing G418 for 3-4 weeks Mock transfected cell lines (cells transfected with vector only) are used as controls.

Viral Vectors

Recombinant viral vectors containing the nucleic acid of interest can also be used to introduce nucleic acid into a cell ex vivo or in vitro. It is noted that viral vectors are also used to transfect cells in vivo. These viral vectors can be DNA viruses such as herpesviruses, adenoviruses, and vaccinia viruses or RNA viruses such as retroviruses. The method and materials required to produce and use these viral vectors ex vivo, in vitro, and in vivo are commonly known in the art and are used in the invention described herein (Sambrook, J. et al., supra).

Selection:

Regardless of the method used to transfect a particular cell type, stably transfected cells are identified as follows. The DNA of interest contains a selectable marker. Typically, a selectable marker encodes a polypeptide that confers drug resistance and the DNA containing this resistance conferring nucleic acid is transfected into the recipient cell. Post transfection, the treated cells are allowed to grow for a period of time (24-48) hours to allow for efficient expression of the selectable marker. After an appropriate incubation time, transfected cells are treated with media containing the concentration of drug appropriate for the selective survival and expansion of the transfected and now drug resistant cells.

Many drug as well as non-drug selection methods are known in the art and can be used in the invention described herein. For example, a detailed description of currently available drug selection strategies is provided in Kriegler M., Gene Transfer and Expression, A Laboratory Manual, W.H. Freeman and Co. New York, N.Y. pp. 103-107 (1991).

General Method:

Sixteen hours after transfection, the transfected/infected cells are fed with fresh, non-selective media. Twenty-four to forty-eight hours later, the cultures are split to a 1:5 or greater dilution and plated in drug-containing media. It is noted that cells are not placed in drug-containing media immediately after transfection in order to allow a sufficient amount of time for the drug resistance nucleic acid to be expressed and thus confer the drug resistant phenotype. Cell cultures are re-fed with drug-containing media every three days, at which time cultures are examined under a microscope to determine the efficiency of drug selection.

Site-Directed Mutagenesis by Polymerase Chain Reaction:
Introduction of Restriction Endonuclease Sites by PCR PCR is the preferred method for introducing any desired sequence change into the DNA. The basic protocol is as follows:

Materials:
DNA sample to be mutagenized, pUC19 plasmid b vector or similar high-copy number plasmid having M13 flanking primer 500 ng/ml (100 pM/µl) flanking sequence primers incorporating the restriction enzyme site
TE buffer
10× amplification buffer
2 mM 4dNTP mix
500 ng/ml (100 pM/ml) M13 flanking sequence primers: forward (NEB) and reverse (NEB)
5 U/ml Taq DNA polymerase
Mineral oil
Chloroform
Buffered phenol
100% ethanol
Appropriate restriction endonucleases
500 ml microcentrifuge tube
Automated thermal cycler 1. Subclone DNA to be mutagenized into high-copy number vector using restriction sites flanking the area to be mutated.
2. Prepare template DNA by plasmid miniprep. Resuspend 100 ng in TE buffer to 1 ng/ml final.
3. Synthesize oligonucleotide primers and purify by denaturing polyacrylamide gel electrophoresis. Resuspend oligonucleotides in 500 l TE buffer. Determine absorbance at A260 and adjust to 500 ng/ml.
4. Combine the following in each of two 500 l microcentrifuge tubes, adding oligonucleotides 1 and 2 to separate tubes:
10 ml (10 ng) template DNA
10 ml 10× amplification buffer
10 ml 2 mM 4dNTP mix
1 ml (500 ng) oligonucleotide 1 or 2 (100 pM final)
1 ml (500 ng) appropriate M 13 flanking sequence primer, forward or reverse (100 pM final).
H$_2$O to 99.5 µl
0.5 ml Taq DNA polymerase (5 U/ml)
Overlay reaction with 100 ml mineral oil.
5. Carry out PCR in an automated thermal cycler for 20 to 25 cycles under the following conditions:

45 sec 93° C.
2 min 50° C.
2 min 72° C.
After last cycle, extend for an additional 10 min at 72° C.
6. Analyze 41 by nondenaturing agarose or occurrence gel electrophoresis to verify that the amplification has yielded the predicted product.
7. Remove mineral oil and extract once with chloroform to remove remaining oil. Extract with buffered phenol and concentrate by precipitation with 100% ethanol.
8. Digest half the amplified DNA with the restriction endonucleases for the flanking and introduced sites. Purify digested fragments on a low gelling/melting agarose gel.
9. Ligate and subclone both fragments into an appropriately digested vector to obtain a recombinant plasmid containing a single DNA fragment incorporating the new restriction site.
10. Transform plasmid into E. coli. Prepare DNA by plasmid miniprep.
11. Analyze amplified fragment portion of plasmid by DNA sequencing to confirm the addition of the mutation.

Introduction of Point Mutation by PCR
Materials:
DNA sample to be mutagenized
Oligonucleotide primers incorporating the point mutation
Klenow fragment of E. coli DNA polymerase I
Appropriate restriction endonuclease
Procedure:
1. Prepare template DNA (steps 1 and 2 of Basic Protocol).
2. Synthesize and purify oligonucleotide primers (3 and 4).
3. Amplify template DNA (steps 4 and 5 of Basic Protocol 1). After final extension step, add 5 U Klenow fragment and incubate 15 min at 30° C.).
4. Analyze and process reaction (steps 6 and 7 of Basic Protocol).
5. Digest half the amplified fragments with the restriction endonucleases for the flanking sequences. Purify digested fragments on a low gelling/melting agarose gel.
6. Subclone the two amplified fragments into an appropriately digested vector by blunt-end ligation.
7. Carry out steps 10 and 11 of Basic Protocol.

Introduction of a Point Mutation by Sequential PCR
Steps:
1. Prepare the template DNA (steps 1 and 2 of Basic Protocol 1).
2. Synthesize and purify the oligosaccharide primers (5 and 6).
3. Amplify the template and generate blunt-end fragments (step 3 of Basic Protocol).
4. Purify fragments by nondenaturing agarose gel electrophoresis. Resuspend in TE buffer at 1 ng/ml.
5. Combine the following in 500 ml microcentrifuge tube:
10 ml (10 ng) each amplified fragment
1 ml (500 ng) each flanking sequence primer (each 100 pM final)
10 ml 10× amplification buffer
10 ml 2 mM 4dNTP mix
0.5 ml Taq DNA polymerase (5 U/ml)
Overlay with 100 ml mineral oil.
6. Carry out PCR for 20 to 25 cycles (step 5 of Basic Protocol 1). Analyze and process the reaction mix (steps 6 and 7 of Basic Protocol 1).
7. Digest cDNA fragment with appropriate restriction endonuclease for the flanking sites. Purify fragment on a low gelling/melting agarose gel. Subclone into an appropriately digested vector.
8. Carry out steps 10 and 11, Basic Protocol 1.

Genomic Targeting and Genetic Conversion in Cancer Therapy

A number of cellular transformations are due, in large part, to a single base mutation that alters the function of the expressed protein. Alterations in the DNA sequence of a gene involved in cell proliferation can have a significant effect on the viability of particular cells. Thus, the capacity to modulate the base sequence of such a gene would be a useful tool for cancer therapeutics. An experimental strategy that centers around site-specific DNA base mutation or correction using a unique chimeric oligonucleotide has been developed. This chimeric molecule has demonstrated higher recombinogenic activities than identical oligonucleotides containing only DNA residues, both in vitro and in vivo. The chimeric molecule is designed to hybridize to a target site within the genome and induce a single base mismatch at the residue targeted for mutation. The DNA structure created at this site is recognized by the host cell's repair system which mediates the correction reaction. For example, the bcr-abl fusion gene, the product of a translocation between human chromosomes 9 and 22, and the cause of chronic myelogenous leukemia (CML) can be targeted for gene correction. Fusion genes or mutations which abound in cancer cells are excellent targets for correction especially if (1) they are unique and are recognized by the immune system as dominant or subdominant epitopes, (2) they are a single copy target; (3) the DNA sequence of the fusion gene or mutation is unique. The goal of such experiments is to knock-out the fusion gene by changing an amino acid codon into a stop codon through a chimeric directed DNA repair system.

Targeted Gene Correction of Episomal DNA in Mammalian Cells Mediated by a Chimeric RNA/DNA Oligonucleotide An experimental strategy to facilitate correction of single-base mutations of episomal targets in mammalian cells has been developed. The method utilizes a chimeric oligonucleotide composed of a contiguous stretch of RNA and DNA residues in a duplex conformation with double hairpin caps on the ends. The RNA/DNA sequence is designed to align with the sequence of the mutant locus and to contain the desired nucleotide change. Activity of the chimeric molecule in targeted correction is used in a with the aim of correcting a point mutation in the gene encoding the human liver/bone/kidney alkaline phosphatase. When the chimeric molecule is introduced into cells containing the mutant gene on an extra-chromosomal plasmid, correction of the point mutation is accomplished with a frequency approaching 30%. These results extend the usefulness of the oligonucleotide-based gene targeting approaches by increasing specific targeting frequency.

The site directed mutagenesis is used to carry out using the chimeric DNA/RNA structure which enables the construct to target tumor cells in vivo and in vitro. Such targeting structures include target seeking moieties and can in principle be any structure that is able to bind to a cell surface structure or that binds via biospecific affinity. The target seeking moiety is primarily a disease specific structure selected among hormones, antibodies, growth factors. The biospecific affinity counterpart may include interleukins (especially interleukin-2) antibodies (full length antibody, Fab, F(ab'2), Fv, single chain antibody and any other antigen binding antibody fragments (such as Fab) directed to a cells surface epitope or more preferably towards the binding epitope for the a specific antibody. They may also include polypeptides binding to the constant domains of immunoglobulins (e.g., protein A and G and L), lectins, streptavidin, biotin etc. The term antibodies comprises monoclonal as well as polyclonal preparations. The targeting moiety may also be directed toward unique structures on more or less healthy cells that regulate or control the development of a disease. or ligands for specific receptors on tumor cells). The targeting structure may be a nucleic acid, lipid or carbohydrate and variations thereof which target receptors on the diseased cell. The targeting is not confined to diseased cells but may include additional normal cells as well.

Example 2

Cells Transfected with Nucleic Acids Encoding SAgs

Cultured VX-2 carcinoma cells were shown to retain their tumorigenic activity after implantation into New Zealand white rabbits. Progressive tumor outgrowth was observed over a 3 week period. Nucleic acid encoding SEB isolated and characterized by Gaskill et al, J. Biol. Chem. 263:6276 (1988) and Ranelli et al., Proc. Natl. Acad. Sci. USA 82:5850 (1985) were used to transfect tissue cultured VX-2 carcinoma cells using transfection methodology described in Example 1. Transfectants were selected using G418 and the survival of SEB-transfected VX-2 carcinoma cells was observed. In additional experiments, attempts were made to transfect murine 205 and 207 tumor cells with nucleic acid encoding SEB (the kind gift from Dr. Saleem Khan) and Streptococcal pyrogenic exotoxin A (the kind gift of Dr. Joseph Ferretti). Successful transfection of murine MCA 205 and B16 cells by nucleic acids encoding SEA and SEC2 was achieved shortly thereafter by integrating the SAg DNA into several retroviral vectors (MFG NEO) containing a growth hormone leader sequence under the control of a chick B-actin promoter (Krause J C et al., J. Hematotherapy 6: 41-51 (1997)). In addition, murine tumors MCA 205 fibrosarcoma cells and a spontaneous mammary carcinoma cells were successfully transfected with nucleic acids encoding SEB (provided by Dr. Saleem Khan) using the β-actin promoter. Transfected mammary carcinoma cells induced T cell proliferation in vitro. To demonstrate the anti-tumor capacity of tumor cells transfected with nucleic acid encoding a SAg, these transfectants were injected i.p. into syngeneic hosts with established mammary carcinomas. These transfectants demonstrated a capacity to reduce micrometastases of wild type mammary tumor in vivo assessed in a clonogenic lung metastases assay. The anti-tumor effect produced by the SEB transfectants was enhanced significantly by the co-administration of tumor cells transfected with nucleic acids encoding the costimulating molecule B7-1.

Example 3

Pharmaceutical Compositions and their Manufacture

A preferred delivery system is the sickled erythrocyte containing the nucleic acids of choice a given in Example 6. The sickled erythrocytes undergo ABO and RH phenotyping to select compatible cells for delivery. The cells are delivered intravenously or intrarterially in a blood vessel perfusing a specific tumor site or organ e.g. carotid artery, portal vein, femoral artery etc. over the same amount of time required for the infusion of a conventional blood transfusion. The quantity of cells to be administered in any one treatment would range from one tenth to one half of a full unit of blood. The treatments are generally given every three days for a total of twelve treatments. However, the treatment schedule is flexible and may be given for a longer of shorter duration depending upon the patients response.

Example 4

General Procedures for Administering Constructs in Human Tumor Models and Human Patients The constructs described herein are tested for therapeutic efficacy in several well established rodent models which are considered to be highly representative as described in "Protocols for Screening Chemical Agents and Natural Products Against Animal Tumors and Other Biological Systems (Third Edition)", Cancer Chemother. Reports, Part 3, 3: 1-112, which is hereby incorporated by reference in its entirety. Additional tumor models of carcinoma and sarcoma originating from primary sites and prepared as established tumors at primary and/or metastatic sites are utilized to test further the efficacy of the constructs.

Example 5

General Procedures for Administering Tumor Cells or Sickled Erythrocytes Transduced with SAgs and SAg-Activated T or NKT Cells in Human Tumor Models and Human Patients
A. Tumor Cells Transduced with SAg Nucleic Acids Alone or Cotransfected with Oncogenes or Nucleic Acids Encoding Potent Immunogens and Bacterial Products In a representative protocol, using the B16 melanoma or A20 lymphoma or other models given above, $10^5$-$10^7$ transfected tumor cells are implanted subcutaneously and 1-6 months later $10^5$-$10^7$ untransfected tumor cells, are implanted. In the case of tumor cells cotransfected with several therapeutic nucleic acids, controls are established consisting of groups transfected with only one of the nucleic acids. These single transfectants are administered on the same schedule as the cotransfectants and assessed for capacity to prevent or reverse tumor growth compared to positive controls receiving tumor alone. The animals receiving the SAg transfected tumor cells show no evidence of growth of the wild type tumor and prolonged survival compared to the controls in which there is 100% appearance of the tumors. The differences are statistically significant.
SAg transfected tumor cells are also used to treat established tumors as follows. Transfected tumor cells, $10^5$-$10^7$ are given 3-10 days after the appearance of established tumors. Results show statistically significant arrest of tumor growth, prolongation of survival in treated animals compared to untreated controls.
B. SAg-Activated Effector T or NKT Cells
Effector T or NKT cells are generated as described elsewhere and are infused intravenously in doses of $10^6$-$10^8$ into syngeneic hosts that have pulmonary metastatic lesions established by injecting tumor cells intravenously 3 to 12 days earlier. Twenty days later, the animals are sacrificed and pulmonary metastases measured in treated animals compared to untreated controls. Results show statistically significant reduction in total number of pulmonary nodules and prolonged survival in the treated group compared to untreated controls.

Example 6

General Test Evaluation Procedures for Constructs and SAg Activated Effector T or NKT Cells
I. General Test Evaluation Procedures
A. Calculation of Mean Survival Time
Mean survival time is calculated according to the following formula:

$$\text{Mean survival time (days)} = \frac{S + AS_{(A-1)} - (B+1)NT}{S_{(A-1)} - NT}$$

DEFINITIONS

Day: Day on which deaths are no longer considered due to drug toxicity. Example: with treatment starting on Day 1 for survival systems (such as L1210, P388, B16, 3LL, and W256):
Day A: Day 6.
Day B: Day beyond which control group survivors are considered "no-takes."
Example: with treatment starting on Day 1 for survival systems (such as L1210, P388, and W256), Day B-Day 18. For B16, transplanted AKR, and 3LL survival systems, Day B is to be established.
S: If there are "no-takes" in the treated group, S is the sum from Day A through Day B. If there are no "no-takes" in the treated group, S is the sum of daily survivors from Day A onward.
$S_{(A-1)}$: Number of survivors at the end of Day (A-1).
Example: for 3LE21, $S_{(A-1)}$=number of survivors on Day 5.
NT: Number of "no-takes" according to the criteria given in Protocols 7.300 and 11.103.
B. T/C Computed for all Treated Groups T/C is the ratio (expressed as a percent) of the mean survival time of the treated group divided by the mean survival time of the control group. Treated group animals surviving beyond Day B, according to the chart below, are eliminated from calculations:

| No. of survivors in treated group beyond Day B | Percent of "no-takes" in control group | Conclusion |
| --- | --- | --- |
| 1 | Any percent | "no-take" |
| 2 | <10 | drug inhibition |
|   | ≧10 | "no-takes" |
| ≧3 | <15 | drug inhibitions |
|   | ≧15 | "no-takes" |

Positive control compounds are not considered to have "no-takes" regardless of the number of "no-takes" in the control group. Thus, all survivors on Day B are used in the calculation of T/C for the positive control. Surviving animals are evaluated and recorded on the day of evaluation as "cures" or "no-takes."
Calculation of Median Survival Time Median Survival Time is defined as the median day of death for a test or control group. If deaths are arranged in chronological order of occurrence (assigning to survivors, on the final day of observation, a "day of death" equal to that day), the median day of death is a day selected so that one half of the animals died earlier and the other half died later or survived. If the total number of animals is odd, the median day of death is the day that the middle animal in the chronological arrangement died. If the total number of animals is even, the median is the arithmetical mean of the two middle values. Median survival time is computed on the basis of the entire population and there are no deletion of early deaths or survivors, with the following exception:
C. Computation of Median Survival Time from Survivors If the total number of animals including survivors (N) is even, the median survival time (days) (X+Y)/2, where X is the earlier day when the number of survivors is N/2, and Y is the earliest day when the number of survivors (N/2)-1. If N is odd, the median survival time (days) is X.

D. Computation of Median Survival Time from Mortality Distribution

If the total number of animals including survivors (N) is even, the median survival time (days) (X+Y)/2, where X is the earliest day when the cumulative number of deaths is N/2, and Y is the earliest day when the cumulative number of deaths is (N/2)+1. If N is odd, the median survival time (days) is X.

Cures and "No-Takes": "Cures" and "no-takes" in systems evaluated by median survival time are based upon the day of evaluation. On the day of evaluation any survivor not considered a "no-take" is recorded as a "cure." Survivors on day of evaluation are recorded as "cures" or "no-takes," but not eliminated from the calculation of the median survival time.

E. Calculation of Approximate Tumor Weight from Measurement of Tumor Diameters with Vernier Calipers The use of diameter measurements (with Vernier calipers) for estimating treatment effectiveness on local tumor size permits retention of the animals for lifespan observations. When the tumor is implanted sc, tumor weight is estimated from tumor diameter measurements as follows. The resultant local tumor is considered a prolate ellipsoid with one long axis and two short axes. The two short axes are assumed to be equal. The longest diameter (length) and the shortest diameter (width) are measured with Vernier calipers. Assuming specific gravity is approximately 1.0, and Pi is about 3, the mass (in mg) is calculated by multiplying the length of the tumor by the width squared and dividing the product by two. Thus, $$\text{Tumor weight (mg)} = \frac{\text{length (mm)} \times (\text{width [mm]})^2}{2} \text{ Or } \frac{L \times (W)^2}{2}$$

The reporting of tumor weights calculated in this way is acceptable inasmuch as the assumptions result in as much accuracy as the experimental method warrants.

F. Calculation of Tumor Diameters

The effects of a drug on the local tumor diameter may be reported directly as tumor diameters without conversion to tumor weight. To assess tumor inhibition by comparing the tumor diameters of treated animals with the tumor diameters of control animals, the three diameters of a tumor are averaged (the long axis and the two short axes). A tumor diameter T/C of 75% or less indicates activity and a T/C of 75% is approximately equivalent to a tumor weight T/C of 42%.

G. Calculation of Mean Tumor Weight from Individual Excised Tumors

The mean tumor weight is defined as the sum of the weights of individual excised tumors divided by the number of tumors. This calculation is modified according to the rules listed below regarding "no-takes." Small tumors weighing 39 mg or less in control mice or 99 mg or less in control rats, are regarded as "no-takes" and eliminated from the computations. In treated groups, such tumors are defined as "no-takes" or as true drug inhibitions according to the following rules:

| Percent of small tumors in treated group | Percent of "no-takes" in control group | Action |
|---|---|---|
| ≦17 | Any percent | no-take; not used in calculations |
| 18-39 | <10 | drug inhibition; use in calculations |
| | ≧10 | no-takes; not used in calculations |
| ≧40 | <15 | drug inhibition; use in calculations |
| | ≧15 | Code all nontoxic tests "33" |

Positive control compounds are not considered to have "no-takes" regardless of the number of "no-takes" in the control group. Thus, the tumor weights of all surviving animals are used in the calculation of T/C for the positive control. T/C are computed for all treated groups having more than 65% survivors. The T/C is the ratio (expressed as a percent) of the mean tumor weight for treated animals divided by the mean tumor weight for control animals. SDs of the mean control tumor weight are computed the factors in a table designed to estimate SD using the estimating factor for SD given the range (difference between highest and lowest observation). *Biometrik Tables for Statisticians* (Pearson E S, and Hartley H G, eds.) Cambridge Press, vol. 1, table 22, p. 165.

II. Specific Tumor Models

A. Lymphoid Leukemia L1210

Summary: Ascitic fluid from donor mouse is transferred into recipient $BDF_1$ or $CDF_1$ mice. Treatment begins 24 hours after implant. Results are expressed as a percentage of control survival time. Under normal conditions, the inoculum site for primary screening is i.p., the composition being tested is administered i.p., and the parameter is mean survival time. Origin of tumor line: induced in 1948 in spleen and lymph nodes of mice by painting skin with MCA. *J Natl Cancer Inst.* 13:1328 (1953).

Animals:
Propagation: DBA/2 mice (or $BDF_1$ or $CDF_1$ for one generation).
Testing: $BDF_1$ (C57BL/6×DBA/2) or $CDF_1$ (BALB/c×DBA/2) mice.
Weight: Within a 3-g weight range, with a minimum weight of 18 g for males and 17 g for females.
Sex: One sex used for all test and control animals in one experiment.
Experiment Size Six animals per test group.
Control Groups Number of animals varies according to number of test groups.
Tumor Transfer:
Inject i.p., 0.1 ml of diluted ascitic fluid containing $10^5$ cells.
Time of Transfer for Propagation: Day 6 or 7.
Time of Transfer for Testing: Day 6 or 7.
Testing Schedule
Day 0: Implant tumor. Prepare materials. Run positive control in every odd-numbered experiment. Record survivors daily.
Day 1: Weigh and randomize animals. Begin treatment with therapeutic composition. Typically, mice receive 1 ug of the test composition in 0.5 ml saline. Controls receive saline alone. The treatment is given as one dose per week. Any surviving mice are sacrificed after 4 weeks of therapy.
Day 5: Weigh animals and record.
Day 20: If there are no survivors except those treated with positive control compound, evaluate study.
Day 30: Kill all survivors and evaluate experiment.

Quality Control
Acceptable control survival time is 8-10 days. Positive control compound is 5-fluorouracil; single dose is 200 mg/kg/injection, intermittent dose is 60 mg/kg/injection, and chronic dose is 20 mg/kg/injection. Ratio of tumor to control (T/C) lower limit for positive control compound is 135%

Evaluation

Compute mean animal weight on Days 1 and 5, and at the completion of testing compute T/C for all test groups with >65% survivors on Day 5. A T/C value 85% indicates a toxic test. An initial T/C 125% is considered necessary to demonstrate activity. A reproduced T/C 125% is considered worthy of further study. For confirmed activity a composition should have two multi-dose assays that produce a T/C 25%.

B. Lymphocytic Leukemia P388

Summary: Ascitic fluid from donor mouse is implanted in recipient $BDF_1$ or $CDF_1$ mice. Treatment begins 24 hours after implant. Results are expressed as a percentage of control survival time. Under normal conditions, the inoculum site for primary screening is ip, the composition being tested is administered ip daily for 9 days, and the parameter is median survival time. Origin of tumor line: induced in 1955 in a DBA/2 mouse by painting with MCA. *Scientific Proceedings, Pathologists and Bacteriologists* 33:603, 1957.

Animals:

Propagation: DBA/2 mice (or $BDF_1$ or $CDF_1$ for one generation)

Testing: $BDF_1$ (C57BL/6×DBA/2) or $CDF_1$ (BALB/c×DBA/2) mice.

Weight: Within a 3-g weight range, with a minimum weight of 18 g for males and 17 g for females.

Sex: One sex used for all test and control animals in one experiment.

Experiment Size: Six animals per test group.

Control Groups Number of animals varies according to number of test groups.

Tumor Transfer

Implant: Inject ip

Size of Implant: 0.1 ml diluted ascitic fluid containing $10^6$ cells.

Time of Transfer for Propagation: Day 7.

Time of Transfer for Testing: Day 6 or 7.

Testing Schedule

Day 0: Implant tumor. Prepare materials. Run positive control in every odd-numbered experiment. Record survivors daily.

Day 1: Weigh and randomize animals. Begin treatment with therapeutic composition. Typically, mice receive 1 ug of the composition being tested in 0.5 ml saline. Controls receive saline alone. The treatment is given as one dose per week. Any surviving mice are sacrificed after 4 weeks of therapy.

Day 5: Weigh animals and record.

Day 20: If there are no survivors except those treated with positive control compound, evaluate experiment.

Day 30: Kill all survivors and evaluate experiment.

Quality Control

Acceptable median survival time is 9-14 days. Positive control compound is 5-fluorouracil: single dose is 200 mg/kg/injection, intermittent dose is 60 mg/kg/injection, and chronic dose is 20 mg/kg/injection. T/C lower limit for positive control compound is 135% Check control deaths, no takes, etc.

Evaluation

Compute mean animal weight on Days 1 and 5, and at the completion of testing compute T/C for all test groups with >65% survivors on Day 5. A T/C value 85% indicates a toxic test. An initial T/C 125% is considered necessary to demonstrate activity. A reproduced T/C 125% is considered worthy of further study. For confirmed activity a synthetic must have two multi-dose assays (each performed at a different laboratory) that produce a T/C 125%; a natural product must have two different samples that produce a T/C 125% in multi-dose assays.

C. Melanotic Melanoma B 16

Summary: Tumor homogenate is implanted ip or sc in $BDF_1$ mice. Treatment begins 24 hours after either ip or sc implant or is delayed until an sc tumor of specified size (usually approximately 400 mg) can be palpated. Results expressed as a percentage of control survival time. The composition being tested is administered ip, and the parameter is mean survival time. Origin of tumor line: arose spontaneously in 1954 on the skin at the base of the ear in a C57BL/6 mouse. *Handbook on Genetically Standardized Jax Mice*. Roscoe B. Jackson Memorial Laboratory, Bar Harbor, Me., 1962. See also *Ann NY Acad Sci* 100, Parts 1 and 2, 1963.

Animals:

Propagation: C57BL/6 mice.

Testing: $BDF_1$ (C57BL/6×DBA/2) mice.

Weight: Within a 3-g weight range, with a minimum weight of 18 g for males and 17 g for females.

Sex: One sex used for all test and control animals in one experiment.

Experiment Size Ten animals per test group. For control groups, the number of animals varies according to number of test groups.

Tumor Transfer

Propagation: Implant fragment sc by trochar or 12-gauge needle or tumor homogenate (see below) every 10-14 days into axillary region with puncture in inguinal region.

Testing: Excise sc tumor on Day 10-14.

Homogenate: Mix 1 g or tumor with 10 ml of cold balanced salt solution and homogenize, and implant 0.5 ml of this tumor homogenate ip or sc.

Fragment: A 25-mg fragment may be implanted sc.

Testing Schedule

Day 0: Implant tumor. Prepare materials. Run positive control in every odd-numbered experiment. Record survivors daily.

Day 1: Weigh and randomize animals. Begin treatment with therapeutic composition. Typically, mice receive 1 μg of the composition being tested in 0.5 ml saline. Controls receive saline alone. The treatment is given as one dose per week. Any surviving mice are sacrificed 8 weeks of therapy.

Day 5: Weigh animals and record.

Day 60: Kill all survivors and evaluate experiment.

Quality Control

Acceptable control survival time is 14-22 days. Positive control compound is 5-fluorouracil: single dose is 200 mg/kg/injection, intermittent dose is 60 mg/kg/injection, and chronic dose is 20 mg/kg/injection. T/C lower limit for positive control compound is 135% Check control deaths, no takes, etc.

Evaluation

Compute mean animal weight on Days 1 and 5, and at the completion of testing compute T/C for all test groups with >65% survivors on Day 5. A T/C value 85% indicates a toxic test. An initial T/C 125% is considered necessary to demonstrate activity. A reproduced T/C 125% is considered worthy of further study. For confirmed activity a therapeutic composition should have two multi-dose assays that produce a T/C 125%.

Metastasis after IV Injection of Tumor Cells $10^5$ B16 melanoma cells in 0.3 ml saline are injected intravenously in C57BL/6 mice. The mice are treated intravenously with 1 g of the composition being tested in 0.5 ml saline. Controls receive saline alone. The treatment is given as one dose per week. Mice sacrificed after 4 weeks of therapy, the lungs are removed and metastases are enumerated.

C. 3LL Lewis Lung Carcinoma

Summary: Tumor may be implanted sc as a 2-4 mm fragment, or im as a $2 \times 10^6$-cell inoculum. Treatment begins 24 hours after implant or is delayed until a tumor of specified size (usually approximately 400 mg) can be palpated. The composition being tested is administered ip daily for 11 days and the results are expressed as a percentage of the control.

Origin of tumor line: arose spontaneously in 1951 as carcinoma of the lung in a C57BL/6 mouse. Cancer Res 15:39, 1955. See, also Malave, I. et al., *J. Nat'l. Canc. Inst.* 62:83-88 (1979).

Animals:
Propagation: C57BL/6 mice.
Testing: $BDF_1$ mice or C3H.
Weight: Within a 3-g weight range, with a minimum weight of 18 g for males and 17 g for females.
Sex: One sex used for all test and control animals in one experiment.
Experiment Size Six animals per test group for sc implant, or ten for im implant. For control groups, the number of animals varies according to number of test groups.

Tumor Transfer
Implant: Inject cells im in hind leg or implant fragment sc in axillary region with puncture in inguinal region.
Time of Transfer for Propagation: Days 12-14.
Time of Transfer for Testing: Days 12-14.

Testing Schedule
Day 0: Implant tumor. Prepare materials. Run positive control in every odd-numbered experiment. Record survivors daily.
Day 1: Weigh and randomize animals. Begin treatment with therapeutic composition. Typically, mice receive 1 ug of the composition being tested in 0.5 ml saline. Controls receive saline alone. The treatment is given as one dose per week. Any surviving mice are sacrificed after 4 weeks of therapy.
Day 5: Weigh animals and record.
Final Day: Kill all survivors and evaluate experiment.

Quality Control
Acceptable im tumor weight on Day 12 is 500-2500 mg. Acceptable im tumor median survival time is 18-28 days. Positive control compound is cyclophosphamide: 20 mg/kg/injection, qd, Days 1-11. Check control deaths, no takes, etc.

Evaluation
Compute mean animal weight when appropriate, and at the completion of testing compute T/C for all test groups. When the parameter is tumor weight, a reproducible T/C 42% is considered necessary to demonstrate activity. When the parameter is survival time, a reproducible T/C 125% is considered necessary to demonstrate activity. For confirmed activity a synthetic must have two multi-dose assays (each performed at a different laboratory); a natural product must have two different samples.

D. 3LL Lewis Lung Carcinoma Metastasis Model
This model has been utilized by a number of investigators. See, for example, Gorelik, E. et al., *J. Nat'l. Canc. Inst.* 65:1257-1264 (1980); Gorelik, E. et al., *Rec. Results Canc. Res.* 75:20-28 (1980); Isakov, N. et al., *Invasion Metas.* 2:12-32 (1982) Talmadge J. E. et al., *J. Nat'l. Canc. Inst.* 69:975-980 (1982); Hilgard, P. et al., *Br. J. Cancer* 35:78-86 (1977)).
Mice: male C57BL/6 mice, 2-3 months old.
Tumor: The 3LL Lewis Lung Carcinoma was maintained by sc transfers in C57BL/6 mice. Following sc, im or intra-footpad transplantation, this tumor produces metastases, preferentially in the lungs. Single-cell suspensions are prepared from solid tumors by treating minced tumor tissue with a solution of 0.3% trypsin. Cells are washed 3 times with PBS (pH 7.4) and suspended in PBS. Viability of the 3LL cells prepared in this way is generally about 95-99% (by trypan blue dye exclusion). Viable tumor cells ($3 \times 10^4$-$5 \times 10^6$) suspended in 0.05 ml PBS are injected into the right hind foot pads of C57BL/6 mice. The day of tumor appearance and the diameters of established tumors are measured by caliper every two days.

Typically, mice receive 1 ug of the composition being tested in 0.5 ml saline. Controls receive saline alone. The treatment is given as one or two doses per week. In experiments involving tumor excision, mice with tumors 8-10 mm in diameter are divided into two groups. In one group, legs with tumors are amputated after ligation above the knee joints. Mice in the second group are left intact as nonamputated tumor-bearing controls. Amputation of a tumor-free leg in a tumor-bearing mouse has no known effect on subsequent metastasis, ruling out possible effects of anesthesia, stress or surgery. Surgery is performed under Nembutal anesthesia (60 mg veterinary Nembutal per kg body weight).

Determination of Metastasis Spread and Growth
Mice are killed 10-14 days after amputation. Lungs are removed and weighed. Lungs are fixed in Bouin's solution and the number of visible metastases is recorded. The diameters of the metastases are also measured using a binocular stereoscope equipped with a micrometer-containing ocular under 8× magnification. On the basis of the recorded diameters, it is possible to calculate the volume of each metastasis. To determine the total volume of metastases per lung, the mean number of visible metastases is multiplied by the mean volume of metastases. To further determine metastatic growth, it is possible to measure incorporation of $^{125}$IdUrd into lung cells (Thakur, M. L. et al., *J. Lab. Clin. Med.* 89:217-228 (1977). Ten days following tumor amputation, 25 μg of FdUrd is inoculated into the peritoneums of tumor-bearing (and, if used, tumor-resected mice. After 30 min, mice are given 1 μCi of $^{125}$IdUrd. One day later, lungs and spleens are removed and weighed, and a degree of $^{125}$IdUrd incorporation is measured using a gamma counter.

Statistics: Values representing the incidence of metastases and their growth in the lungs of tumor-bearing mice are not normally distributed. Therefore, non-parametric statistics such as the Mann-Whitney U-Test may be used for analysis.

Study of this model by Gorelik et al. (1980, supra) showed that the size of the tumor cell inoculum determined the extent of metastatic growth. The rate of metastasis in the lungs of operated mice was different from primary tumor-bearing mice. Thus in the lungs of mice in which the primary tumor had been induced by inoculation of large doses of 3LL cells ($1$-$5 \times 10^6$) followed by surgical removal, the number of metastases was lower than that in nonoperated tumor-bearing mice, though the volume of metastases was higher than in the nonoperated controls. Using $^{125}$IdUrd incorporation as a measure of lung metastasis, no significant differences were found between the lungs of tumor-excised mice and tumor-bearing mice originally inoculated with $1 \times 10^6$ 3LL cells. Amputation of tumors produced following inoculation of $1 \times 10^5$ tumor cells dramatically accelerated metastatic growth. These results were in accord with the survival of mice after excision of local tumors. The phenomenon of acceleration of metastatic growth following excision of local tumors had been observed by other investigators. The growth rate and incidence of pulmonary metastasis were highest in mice inoculated with the lowest doses ($3 \times 10^4$-$1 \times 10^5$) of tumor cells) and characterized also by the longest latency periods before local tumor appearance. Immunosuppression accelerated metastatic growth, though nonimmunologic mechanisms participate in the control exerted by the local tumor on lung metastasis development. These observations have implications for the prognosis of patients who undergo cancer surgery.

E. Walker Carcinosarcoma 256
Summary: Tumor may be implanted sc in the axillary region as a 2-6 mm fragment, im in the thigh as a 0.2-ml inoculum of tumor homogenate containing $10^6$ viable cells, or ip as a 0.1-ml suspension containing $10^6$ viable cells. Treatment of the composition being tested is usually ip. Origin of tumor line: arose spontaneously in 1928 in the region of the mammary gland of a pregnant albino rat. *J Natl Cancer Inst* 13:1356, 1953.

Animals:
Propagation: Random-bred albino Sprague-Dawley rats.
Testing: Fischer 344 rats or random-bred albino rats.
Weight Range: 50-70 g (maximum of 10-g weight range within each experiment).
Sex: One sex used for all test and control animals in one experiment.
Experiment Size Six animals per test group. For control groups, the number of animals varies according to number of test groups.
Time of Tumor Transfer
Time of Transfer for Propagation: Day 7 for im or ip implant; Days 11-13 for sc implant.
Time of Transfer for Testing: Day 7 for im or ip implant; Days 11-13 for sc implant.
Tumor Transfer
Sc fragment implant is by trochar or 12-gauge needle into axillary region with puncture in inguinal area. Im implant is with 0.2 ml of tumor homogenate (containing $10^6$ viable cells) into the thigh. Ip implant is with 0.1 ml of suspension (containing $10^6$ viable cells) into the ip cavity.
Testing Schedule
Prepare and administer compositions under test on days, weigh animals, and evaluate test on the days listed in the following tables.

| Test system | Prepare drug | Administer drug | Weight animals | Evaluate |
|---|---|---|---|---|
| 5WA16 | 2 | 3-6 | 3 and 7 | 7 |
| 5WA12 | 0 | 1-5 | 1 and 5 | 10-14 |
| 5WA31 | 0 | 1-9 | 1 and 5 | 30 |

Day 0: Implant tumor. Prepare materials. Run positive control in every odd-numbered experiment. Record survivors daily.
Day 1: Weigh and randomize animals.
Final Day: Kill all survivors and evaluate experiment.
Quality Control
Acceptable im tumor weight or survival time for the above three test systems: 5WA16: 3-12 g. 5WA12: 3-12 g. 5WA31 or 5WA21: 5-9 days.
Evaluation
Compute mean animal weight when appropriate, and at the completion of testing compute T/C for all test groups. When the parameter is tumor weight, a reproducible T/C 42% is considered necessary to demonstrate activity. When the parameter is survival time, a reproducible T/C 125% is considered necessary to demonstrate activity. For confirmed activity a therapeutic agent must have activity in two multi-dose assays.

F. A20 Lymphoma
$10^6$ murine A20 lymphoma cells in 0.3 ml saline are injected subcutaneously in Balb/c mice. The mice are treated intravenously with 1 g of the composition being tested in 0.5 ml saline. Controls receive saline alone. The treatment is given as one dose per week. Tumor growth is monitored daily by physical measurement of tumor size and calculation of total tumor volume. After 4 weeks of therapy the mice are sacrificed.

Use in Established Tumors
For proteins or nucleic acid constructs, treatment consists of injecting animals iv or ip with 50, 500 1000 or 5,000 ng of in 0.1-0.5 ml of normal saline. Unless indicated otherwise above, treatments are given one to three times per week for two to five weeks. Phage displays are administered as $10^9$ transducing units (TU) and irradiated bacterial cells as $10^5$ cells iv into the tail vein one to three times per week for two to five weeks. Exosomes or vesicles, harvested from transfected, transformed or fusion tumor cells or sickled cells are given i.v. into the tail vein in a dose of 0.25-1 g per animal one to three times per week for two to five weeks. The results shown in Table VI are for each composition and dose tested. The results are statistically significant by the Wilcoxon rank sum test.

TABLE VI

| Tumor Model | Parameter | % of Control Response |
|---|---|---|
| L1210 | Mean survival time | >130% |
| P388 | Mean survival time | >130% |
| B16 | Mean survival time | >130% |
| B16 metastasis | Median number of metastases | <70% |
| 3LL | Mean survival time | >130% |
|  | Mean tumor weight | <40% |
| 3LL metastasis | Median survival time | >130% |
|  | Mean lung weight | <60 |
|  | Median number of metastases | <60% |
|  | Median volume of metastases | <60% |
|  | Medial volume of metastases | <60% |
|  | Median uptake of IdUrd | <60% |
| Walker carcinoma | Median survival time | >130% |
|  | Mean tumor weight | <40% |
| A20 | Mean survival time | >130% |
|  | Mean tumor volume | <40% |

Antitumor Effects of Therapeutic Constructs and Effector T, NKT Cells or Sickled Erythrocytes in Human Patients
All patients treated have histologically confirmed malignant disease including carcinomas, sarcomas, melanomas, lymphomas and leukemia and have failed conventional therapy. Patients may be diagnosed as having any stage of metastatic disease involving any organ system. Staging describes both tumor and host, including organ of origin of the tumor, histologic type and histologic grade, extent of tumor size, site of metastases and functional status of the patient. A general classification includes the known ranges of Stage I (localized disease) to Stage 4 (widespread metastases). Patient history is obtained and physical examination performed along with conventional tests of cardiovascular and pulmonary function and appropriate radiologic procedures. Histopathology is obtained to verify malignant disease.

Example 7

Treatment Procedures
Constructs (or Preparations)
Doses of the constructs are determined as described above using, inter alia, appropriate animal models of tumors. Treatments are given 3x/week for a total of 12 treatments. Patients with stable or regressing disease are treated beyond the $12^{th}$ treatment. Treatment is given on either an outpatient or inpatient basis as needed.
Patient Evaluation
Assessment of response of the tumor to the therapy is made once per week during therapy and 30 days thereafter. Depending on the response to treatment, side effects, and the health status of the patient, treatment is terminated or prolonged from the standard protocol given above. Tumor response criteria are those established by the International Union Against Cancer and are listed in Table VII.

TABLE VII

| RESPONSE | DEFINITION |
| --- | --- |
| Complete remission (CR) | Disappearance of all evidence of disease |
| Partial remission (PR) | >50% decrease in the product of the two greatest perpendicular tumor diameters; no new lesions |
| Less than partial remission (<PR) | 25-50% decrease in tumor size, stable for at least 1 month |
| Stable disease | <25% reduction in tumor size; no progression or new lesions |
| Progression | >25% increase in size of any one measured lesion or appearance of new lesions despite stabilization or remission of disease in other measured sites |

The efficacy of the therapy in a population is evaluated using conventional statistical methods including, for example, the Chi Square test or Fisher's exact test. Long-term changes in and short term changes in measurements can be evaluated separately.

Results

One hundred and fifty patients are treated. The results are summarized in Table VIII. Positive tumor responses are observed in 80% of the patients as follows:

TABLE VIII

| All Patients | | |
| --- | --- | --- |
| Response | No. | % |
| PR | 20 | 66% |
| <PR | 10 | 33% |
| Tumor Types | Response | % of Patients |
| Breast Adenocarcinoma | PR + <PR | 80% |
| Gastrointestinal Carcinoma | PR + <PR | 75% |
| Lung Carcinoma | PR + <PR | 75% |
| Prostate Carcinoma | PR + <PR | 75% |
| Lymphoma/Leukemia | PR + <PR | 75% |
| Head and Neck Cancer | PR + <PR | 75% |
| Renal and Bladder Cancer | PR + <PR | 75% |
| Melanoma | PR + <PR | 75% |

Example 8

Methods for Preparing Sickled Erythrocytes for Use as Carriers Tumoricidal Agents The sickled cells are obtained from patients with sickle cell anemia or sickle cell trait. The type of sickle cell disease may be hemoglobin SS, hemoglobin SC, or the combination of hemoglobin SS and β-thalassemia. To determine compatibility of donor sickled erythrocytes with recipient erythrocytes, the donor cells are ABO typed and matched. The tendency of these red cells to adhere to cultured endothelial cells is assayed in vitro by the method of Hebbel R P et al., New Eng. J. Med. 302: 992-995 (1980). The sickled cells are harvested, transfected with appropriate oncolytic or tumor specific viruses, toxins or anaerobic bacteria in vitro by methods given in Example 1. Fifty to 250 cc of transfected sickled erythrocytes is infused intravenously over 1-2 hours. The procedure is repeated two to three times weekly for two to four weeks. Responsive patients are retreated on a similar schedule if tumor reappears. The patient's vital signs are monitored every 10 minutes during the infusion, then every hour for the next 4 hours and Q4-6 hours thereafter.

Infection of nucleated erythrocytes by oncolytic or tumor specific viruses: This is carried out by the method of Muhlemann, O., Akusjarvi, G., in *Adenovirus Methods and Protocols* WSM Wold, editor, Humana Press, Totowa, N.J. (1999). Essential steps are given below. Transfection of nucleated sickled cells with various plasmid DNAs described in section 6 is carried out as in Example 1.

Infection of Sickled Cells with Adenovirus:

Sickled cells are grown in round cell-culture bottles on a magnetic stirrer at 37° C. in MEM spinner cell medium, 5% newborn calf serum, optionally containing 1% penicillin/streptomycin. The cells must be kept in log phase (titer 2-6× $10^5$ cells/mL), doubling time approx 24 h.

1. Start with 2-3×$10^9$ sickled spinner cells, collect them by centrifugation in sterile 1-L plastic bottles by spinning at 900 g at room temperature for 20 min. (Beckman J6M/E centrifuge, JS-4.2 rotor).

2. Decant medium back into the cell-culture bottle (handle under sterile conditions the medium will be reused later), resuspend cells in 200-300 mL MEM without serum (see Note 1), and transfer to a 1-L cell-culture bottle.

3. Infect cells with approx 10 PFU/cell of adenovirus from a high-titer virus preparation. Leave at 37° C. on a magnetic stirrer for 1 h. Dilute cells to approximately 4×$10^5$ cells per mL in a large cell culture bottle with the old MEM medium saved at step 2. Add fresh medium if necessary.

4. Continue incubation at 37° C. for 20-24 h for preparation of late-infected extracts. Additional protocols for infecting sickled cells with various lytic viruses or tumor selective viruses are given in Example 11 and in *Adenovirus Methods and Protocols* WSM Wold, editor, Humana Press, Totowa, N.J. (1999) which is herein incorporated in entirety by reference.

Preparation of the Hypoxia Responsive Element Promoter of the VEGF Gene

Cloning and Sequencing of the Mouse VEGF Promoter Region: The VEGF promoter region is amplified by PCR using genomic DNA isolated from mouse liver, oligonucleotide primers synthesized on the basis of the published DNA sequence (GenBank accession number U41383), and LA Taq DNA polymerase (Takara Biomedicals, Osaka, Japan). The sense and antisense primers are −1215 (5'-TTTAGAAGAT-GAACCGTAAGC-CTAG-3') and +315 (5'-GATAC-CTCTTTCGTCTGCTGA-3'), respectively. The PCR conditions are 94° C. for 5 min followed by 30 cycles of 94° C. for 30 s, 68° C. for 3 min, and 72° C. for 7 min. The PCR product, which contained the 5'-flanking sequence encompassing the putative HRE site, the transcription start site, and the 5'-untranslated region, is gel-purified and subcloned into a TA cloning vector prepared from EcoRV-cut pBluescript KS–™ (Stratagene, La Jolla, Calif.). Several independent clones are sequenced, and a clone is used for additional experiments. Deletion of the HRE site is obtained by digestion with BsaAI, a recognition site of which resides in the middle of the HRE site.

Luciferase Reporter Plasmid Constructs and Luciferase Assays

The VEGF promoter sequence with or without the HRE site in pBluescript KS– is excised by digestion with the appropriate restriction enzymes, gel-purified, and blunt-ended with T4 DNA polymerase, and the fragment was ligated into SmaI-cut pGL2-Basic vector (Promega, Madison, Wis.), yielding plasmids pGLV(HRE)Luc or pGLV (AHRE)Luc, respectively. The orientation of the insert is verified by restriction enzyme analysis. Transient transfection was carried out using Lipotectin (Life Technologies, Inc., Gaithersburg, Md.). As a control for transfection efficiency, pRL-CMV vector (Promega) is cotransfected with test plasmids. pGL2-Control vector (Promega) was used as a positive control. Luciferase activity in cell extracts is assayed 48 h after transfection according to the Dual-Luciferase reporter assay system protocols (Promega) using a luminometer (model TD-20/20; Turner Designs, Sunnyvale, Calif.).

Construction of Retroviral Vectors

Retroviral vector LXSN (provided by Dr. A. D. Miller, Fred Hutchinson Cancer Research Center, Seattle, Wash.) is modified as follows to create a multicloning site. The retroviral vector is digested with EcoRI and XhoI and blunt-ended with T4 DNA polymerase. A SacI/KpnI fragment of pBluescript SK– that is blunt-ended with T4 DNA polymerase is ligated to this vector. This procedure yields retroviral vector LXSN(BA), which has a multicloning site between the BstXl site and the ApaI site of pBluescript KS–. A retroviral vector harboring the VEGF promoter sequence, HSV-TK gene or GFP gene, and SV40pA, all of which are located in a reverse orientation of LTR, is obtained as follows. A SV40pA fragment is prepared by digestion of pZeoSV (Invitrogen Corp., Carlsbad, Calif.) with Acc1 and BamHI. The fragment is gel-purified, blunt-ended with T4 DNA polymerase, and ligated into Bxt/XI-cut and blunt-ended LXSN(BA), yielding a LXSN(BA)/pA vector. The VEGF promoter region with or without the HRE site in pBluescript KS– is excised with EcoRI and San and ligated into EcoRI/SalI-cut LXSN(BA)/pA, generating vectors LV(HRE) and LV(AHRE), respectively. The GFP or HSV-TK gene or any other gene given in section 66 is cloned into the NotI site of these vectors via NotI linkers. The orientation of the inserts is verified by restriction enzyme analysis. The retroviral vectors generated by this procedure are termed LV(HRE)GFP, LV(HRE)TK, and LV(AHRE)TK.

Plasmid Transfection and Retrovirus Infection

Al 1 cells are transfected with the: plasmids using Lipofection. The retroviruses harboring LV(HRE)GFP or LV(HRE)TK are generated by a φ2 packaging cell line. All cells were infected with the retroviruses in the presence of 8 μg/ml polybrene (Aldrich Chemical Co., Inc., Milwaukee, Wis.). The cells are cultured in the presence of 400 μg/ml G418 (Life Technologies, Inc., Grand Island, N.Y.) to select for cells that expressed vector-derived genes.

Evaluation of GFP Expression and Vascularity in Cryosections of Tumors

Cells: $2 \times 10^5$) transfected with LV(HRE)GFP are s.c. injected into the flank of syngeneic C57BL/6 mice (Nippon SLC, Hamamatsu, Japan). Ten days after the injection, tumors are surgically removed and frozen in OCT compound. Cryostat sections are fixed with cold acetone and washed with DPBS, and endogenous peroxidase is blocked with 3% hydrogen peroxide in methanol for 10 min. The samples are washed three times with DPBS and incubated with DPBS containing 10% normal goat serum for 60 min to block non-specific binding sites. They are then incubated with rat anti-mouse CD31 antibody (PharMingen, San Diego, Calif.). Sections are washed with DPBS and incubated with TRITC-conjugated goat antirat IgG. After extensive washings with DPBS, samples are mounted in 50% glycerol in DPBS containing 1 mg/ml phenylenediamine. The fluorescence emitted from GFP and TRITC is observed under a confocal laser microscope (Fluoview; Olympus, Tokyo, Japan).

Alternatively, cells are subjected to hypoxia for 16 h followed by exposure to GCV for 24 h in air, and the cell number was determined 2 days after the treatment.

In Vivo Experiments. Cells ($2.5 \times 10^5$) retrovirally transduced with LV(HRE)TK or LV(HRE) are s.c. injected into 6-week-old female C57BL/6 mice. Ten days after the inoculation, GCV diluted in DPBS is i.p. injected at a concentration of 30 mg/kg twice daily at 8-h intervals for 5 days. DPBS alone is injected into control mice. Tumor growth is monitored by caliper measurement of two diameters at right angles, and the tumor mass is estimated from the equation volume=$0.5 \times a \times b^2$, where a and b are the larger and smaller diameters, respectively.

Example 9

Construction of Adenovirus Vectors with Insertions for Superantigens

Superantigens are inserted into human adenoviruses (Ads) which are used as live viral vector for expression of superantigens in mammalian cells. Adenoviruses vectors are exemplified here for insertion of the superantigen nucleotide. A mutant adenovirus with selectivity for P53 deficient tumors is preferred such as ONYX-015. An efficient and flexible system for construction of adenoviral vector with insertions or deletions in early regions 1 and 3 as described by Bett A J et al., Proc. Natl. Acad. Sci. 91: 8802-8806 (1994) is given below. Similar procedures insertion of the superantigen gene would be applied to the ONYX-014 mutant.

Principle of Method:

Superantigen genes are inserted into adenoviral vectors using the following principles and methods adapted from Bett, A J et al., *Proc. Nat. Acad. Sci.* 91: 8802-8806 (1994). Additional methods are given in a book titled Adenovirus Methods and Protocols Wold, WSM ed. Humana Press, Totowa, N.J. (1999) which is incorporated in entirety by reference. These methods involve insertion of the superantigen DNA either by overlap recombination or by ligation insertion. The method exemplified below for insertion of SAg sequences uses the Ad5DNA virus but may be adapted to the dl1150 or ONYX-015 mutant or any other adenovirus. The Ad5 DNA sequences are cloned into bacterial plasmids. Deletions are made in the early region 1 and (3180 bp) and early region 3 (2690 or 3132 bp) and are combined in a single vector that have a capacity for inserts of up to 8.3 kb, enough to accommodate the majority of cDNAs encoding proteins with regulatory elements. SAg genes are inserted into either early region 1 or 3 or both and mutations or deletions are readily introduced into the viral genome.

SAg genes may be inserted into areas of the viral genome that have been inactivated or deleted and considered to be non-essential to the lytic activity of the virus or its ability to evade the host immune response. Both Ad and HSV carry genes that are not essential for viral replication and these may be utilized for SAg insertion.

The first step is the construction of AdBHG, a virus that contains the Ad5 genome with the deletion of E3 sequences from by 28,133 to 30,818 and the insertion of a restriction enzyme site. The next step is the generation of a bacterial plasmid containing the entire AdBHG genome and subsequent identification of infectious clones. Baby rat kidney (BRK) cells are infected with AdBHG under conditions that result in the generation of circular Ad5 genomes. At 48 h after infection, DNA is extracted from the infected Bark cells and used to transform *E. coli* HMS174 to ampicillin and tetracycline resistance. Plasmids with the complete AdBHG genome are selected. The final step is the generation of the pBHG10 by deleting the packaging signals in pBHG9 by partial BamHI digestion and relegation. A Pac I restriction enzyme site unique to this plasmid is present between Ad5 bp 28,133 and by 30,818 to permit foreign gene insertion. Because the packaging signal is deleted, pBHG10 is non-infectious but cotransfections with plasmids that contain the left-end Ad5 sequences including the packaging signal produce infectious viral vectors with an efficiency comparable to that obtained with pJM17.

Use of the pBHGE3, pBHG10, or pBHG11 combined with the 3.2-kb deletion in E1 permits superantigen DNA inserts of ~5.2, ~7.9, and ~8.3. respectively, into viral vectors. To test the capacity of the BHG system, a 7.8 kb consisting of the lacZ gene driven by the HCM promoter (E1-antiparallel orientation) and the SEB gene driven by the beta actin promoter (E1-parallel orientation) are inserted into the 3.2-kb E1 deletion. The 7.8-kb insert is constructed by inserting the 4.1-kb Xba I fragment from the SEB gene containing the SEB gene driven by the beta actin promoter into the Xba I site in pHCMVsp1LacZ generating pH/acSEB. The isolate pH/acSEB expressed both lacZ and SEB at levels comparable to those obtained with vectors containing single inserts.

The Method:

The first step involves the construction of AdBHG, a virus that contains the Ad5 genome with the deletion of E3 sequences from by 28,133 to 30,818 and the insertion of modified pBR322 at by 1339. AdBHG is made by cotransfection of 293 cells with purified viral DNA from Ad5 PacI, digested with Cia I and Xba I, and pWH3.

The next step involves the generation of a bacterial plasmid containing the entire AdBHG genome and subsequent identification of infectious clones. Baby rat kidney (BRK) cells are infected with AdBHG under conditions that result in the generation of circular Ad5 genomes. At 48 h after infection DNA is extracted from the infected BRK cells and used to transform *E. coli* HMS 174 to ampicillin and tetracycline resistance (Apr and Tetr, respectively). From two experiments, plasmid DNA from a total of 10 colonies is screened by HindIII and BamHI/Sma I digestion and gel electrophoresis. Plasmids that appear to posses a complete AdBHG genome are selected and all four are found to be infectious when transfected into 293 cells.

The final step involves generation of pBHG10 by deleting the packaging signals in pBHG9 by partial BamHI digestion and relegation. The left and right termini of the Ad5 genomes are covalently joined and a segment of plasmid pBR322 is present between AdS bp 188 and 1339 to allow propagation of pBHG10 in *E. coli*. A Pac I restriction enzyme site, unique in this plasmid, is present between AdS bp 28,133 and by 30,818 to permit insertion of the superantigen genes. Because the packaging signal is deleted, pBHG10 is noninfectious but cotransfections with plasmids that contain the left-end Ad5 sequences including the packaging signal produce infectious viral vectors with an efficiency comparable to that obtained with pJM17.

To generate two useful variants, pBHGE3 and pBHG11 are constructed from the original plasmid pBHG10. pBHGE3 permits construction of vectors with wt E3 sequences and pBHG11 increase the cloning capacity of resulting viral vectors. The 2.69-kb E3 deletion in pBHG10 removes the major portions of all E3 mRNAs, the first E3 3' splice acceptor site, and the L4 polyadenylylation site but leaves the E3 promoter, the 5' initiation site, the first E3 5' splice donor site, and the E3b polyadenylylation site intact. Viruses with the 2.69-kb E3 deletion have the same growth kinetics and progeny virus yields as wt virus. The 3.1-kb E3 deletion in pBHG11 removes two additional elements not removed by the 2.69-kb E3 deletion: the first E3 5' splice donor site and the E3b polyadenylylation site. This deletion does not interfere with the open reading frame for pVIII or any of the L5 family of mRNAs. Viruses containing the 3.1-kb deletion give wt progeny yields in infected 293 cells.

To maximize the capacity of the BHG system and to facilitate the introduction of inserts such as the SEB gene into the E1 region, plasmids containing a 3.2-kb deletion of E1 sequences and multiple restriction sites for the insertion of foreign genes have been constructed. This deletion leaves intact the left ITR and packaging signals and extends just past the Spi binding site of the protein IX promoter. The promoter for transcription of the protein IX gene is relatively simple, consisting of this Spi binding site and a TATA box. The Spi binding site is essential for expression of protein IX and it is therefore, reintroduced at a position 1 bp closer to the TATA box than in the wt promoter. However, neither the original 3.2-kb E1 deletion nor the deletion mutants containing the synthetic Spi site are significantly altered in protein IX expression, heat stability or final progeny yields of viruses with this deletion.

General Treatment Plan for Patients with the SAg-dl1150 Construct

SAg-dl1150 is administered intratumorally to patients with recurrent and refractory cancers. The efficacy of SAg-dl1150 treatment is based on the injected tumor(s) response. The clinical benefit of SAg-dl1150 is evaluated through quality-of-life assessment (EORTC instrument), Karnofsky performance score, and pain assessment. Survival and progression-free survival intervals are recorded. Results are given in Example 23 (Table VIII).

SAg-dl1150 Dosages and Dosing Rationale: Patients are treated with SAg-dl1150 administered daily for 5 d at a dose of $10^{10}$ pfu per day. This is the highest dose administered daily for 5 d in the phase I study and was shown to be safe (i.e., no dose-limiting toxicities).

Treatment with SAg-dl1150:

a. Dosing Regimen: For administration of each dose of, patients are treated and observed in a properly equipped outpatient clinic. The target tumor is injected with $10^{10}$ PFU of SAg-dl1150 daily over 5 d (i.e., a total dose $5\times10^{10}$ PFU) (with day 1 being the first day of SAg-dl1150 injection. Nontarget tumor(s) (where applicable) are injected with either diluent or SAg-dl1150 on the same days in identical fashion to the target tumor following the guidelines detailed in steps below.

b. Target Tumor Masses: The dominant, symptom-causing tumor (if symptoms are present) is identified as the target tumor and is the only tumor injected with SAg-dl1150 during the first two treatment cycles. The identification of the most symptomatic, problematic lesion is based on the judgement of the Principal Investigator. Multinodular, but contiguous tumors are treated and evaluated as a single lesion.

c. Secondary, Nontarget Tumor Masses: If additional, smaller, accessible lesions are present, these lesions are injected with diluent for the first two treatment cycles as described in step 3 below. Thereafter, treatments are divided between up to three separate lesions (i.e., the initial two cycles are concentrated within the dominant lesion; thereafter, 6 wk after treatment initiation, two additional secondary lesions are injected). However, the total dose to the patient remains the same (i.e., the same total dose will be divided up between the tumors to be treated); the total volume in which the SAg-dl1150 is suspended will be increased based on the total tumor volume of the tumors to be treated. If a CR occurs in a treated lesion, injections can be continued as outlined above with newly defined dominant and secondary lesions.

d. Immediate Post treatment Monitoring of Patients: The patient's vital signs are taken 15 mm before each SAg-dl1150 injection. After each injection is completed, the patient will be observed in the clinic for a minimum of 30 mm. Vital signs are taken after 30 min±5 mm. If vital sign(s) have changed by

Example 10

Identification and Characterization of Streptococcal Pyrogenic Exotoxins, Staphylococcal Enterotoxins and SETs SPEA Allelic Forms and Mutants. The method of preparation of SPEA allelic forms and mutants is carried out by the method of Kline J B et al., Infect. Immun. 64: 861-869 (1996).

Purification of SPEA from *S. pyogenes*. One-liter cultures of *S. pyogenes* Ros (generous gift of D. L. Stevens, Idaho VA Medical Center) are grown in NCTC-135 medium (Gibco/BRL, Grand Island, N.Y.) supplemented with glucose (21). Toxin was partially purified from cell-free culture filtrates by differential solubility in ethanol and acetate-buffered saline. Toxin which were precipitated four times were redissolved in 0.1 M imidazole-acetic acid (pH 5.0) and applied to a QAE-Sephadex A-50 (Pharmacia Fine Chemicals, Uppsala, Sweden) jacketed column. The toxin was eluted as a single peak with a NaCl gradient as described previously. Sodium dodecyl sulfate (SDS)-poly-acryl-amide gel electrophoresis (PAGE) analysis of purified SPEA reveals a single band with the expected molecular mass of SPEA (25.8 kDa). The toxin is dialyzed against phosphate-buffered saline (PBS) and stored at −20° C.

Construction of pET15b-speaI. 150 ng of plasmid pA2 containing the SPEA gene (kindly provided by J. J. Ferretti, Oklahoma City, Okla.) is used as a template to amplify a 663-bp DNA fragment by PCR using primers

```
19b-A1
(5'-CCCCATATGCAACAAGACCCCGAT-3')
and

19b-A2
(5'-GGGGGATCCTTACTTGGTTGTTAG-3').
```

These primers encode terminal BamHI and NdeI restriction sites, respectively. After digestion with BamHI and NdeI (Gibco/BRL), the DNA fragment, which encodes the mature protein without the leader peptide, is cloned into BamHI- and AMd-digested pET15b (Novagen, Madison, Wis.), producing the construct pET15b speA1. The complete nucleotide sequence of the inserted fragment is confirmed by the dideoxy-chain termination method. In *E. coli* BL21(DE3) (Novagen), this construct expresses a fusion protein consisting of an N-terminal six-histidine-residue tag and SPEA1.

Generation of point mutations in SPEA. Site-directed mutagenesis of SPEA1 is performed by using PCR with oligonucleotides containing the desired nucleotide substitution. Briefly, 150 ng of pET15b-speA1, the mutant oligonucleotide, and either primer 19b-A1 or primer 19b-A2 were used to generate two SPEA fragments with complementary ends. A second PCR is performed with the two overlapping SPEA fragments and flanking primers 19b-A1 and 19b-A2 to generate the full-length mutated SPEA gene. This PCR product is then digested with BamHI and NdeI and inserted into pET15b as described above. The complete nucleotide sequences of both strands of each mutated SPEA are determined by the dideoxy-chain termination method to ensure that only the single desired mutation was present.

Recombinant toxin nomenclature. Recombinant SPEA1 (rSPEA1) amino acid substitution mutants are named according to the original amino acid, its position in the mature toxin, and the resulting amino acid. For example, for rSPEA1-$N_2OA$, amino acid residue 20 was changed from asparagine to alanine. All mutant recombinant proteins generated contain single amino acid substitutions except for rSPEA1-S51L, N55A and rSPEA1-C87S, C90S, which have two substitutions. rSPEA1 is the toxin encoded by SPEA1. rSPEA2 (also referred to as rSPEA1-G80S) is the toxin encoded Expression and purification of rSPEA. Expression and purification of the recombinant toxins by using the pET expression vector is as described by manufacturer (Novagen). In brief, *E. coli* BL21 (DE3) was transformed with pET15-SPEA constructs for production of recombinant toxins. In this background, SPEA is under the control of a T7 promoter, and the T7 polymerase gene is on the *E. coli* chromosome under the control of an isopropylthio-D-galactopyranoside (IPTG)-inducible lac promoter. Cultures are grown to mid-exponential phase and induced to express toxin by the addition of 0.4 mM IPTG (Sigma Chemical Co., St Louis, Mo.). Cultures are grown for an additional 3 h after induction, harvested by centrifugation, and disrupted by sonication. rSPEA preparations are purified by metal chelation chromatography using His-Bind resin (Novagen). One hundred to 500 fg of toxin are digested with 1 μg of thrombin (Novagen) for 16 h at room temperature. The toxin is then purified from the His-tag leader sequence by ultrafiltration with 10,000-molecular-weight cutoff filters (MSI, Westboro, Mass.). In *E. coli* BL21 (DE3) (Novagen), this construct expresses a fusion protein consisting of an N-terminal six-histidine-residue tag and SPEA.

Generation of polyclonal antisera recognizing SPEA. Female New Zealand White rabbits are by SPEA2. The toxin encoded by SPEA1, SPEA3, is also termed rSPEA1-V761. immunized subcutaneously with 50 μg of commercially available SPEA1 (Toxin Technologies, Sarasota, Fla.) in complete Freund's adjuvant (Gibco/BRL). Subsequent immunizations of 25 mg of toxin are administered at week 3 and then every 2 weeks in incomplete Freund's adjuvant (Gibco/BRL). Sera were first collected at week 6.

Western blot (immunoblot) analysis of rSPEA. Each of the mutant toxins and allelic forms is screened for instability by Western analysis. Toxins are analyzed by SDS-PAGE (12% acrylamide) and electroblotted to nitrocellulose. The nitrocellulose filters are incubated overnight in PBS supplemented with 5% low-fat dry milk and then stained with polyclonal rabbit antiserum against SPEA1. Anti-SPEA antibody binding is detected with horseradish peroxidase-labeled goat anti-rabbit antibody. Bands were visualized with 4-chloro-1-naph-thol (Sigma).

SDS-PAGE analysis. To look for the presence of disulfide bond formation between cysteine residues of rSPEA1,2-pg aliquots of purified toxins are mixed with gel running buffer (50 mM Tris-HCl [pH 6.8], 2% SDS, 0.1% bromophenol blue, 10% glycerol) with or without 2-mercaptoethanol (final concentration, 1%). The samples are then boiled for 5 min and electrophoresed for 5 h at 40 mA on an SDS-12% polyacrylamide gel Protein bands were visualized by staining with Coomassie brilliant blue R250 (Bio-Rad, Melville, N.Y.).

Mitogenicity assays. Heparinized whole blood is obtained from healthy donors. Samples were fractionated on Ficoll-Paque (Pharmacia Biotech, Piscataway, N.J.), and the peripheral blood mononuclear cells (PBMCs) are harvested and washed three times in PBS. Then cells ($10^5$) were added to 96-well U-bottom plates in 200 µl of complete RPMI1640 supplemented with 10% fetal calf serum (PCS). PBMCs are incubated for 72 h at 37° C. with various concentrations of rSPEA toxins under atmospheric conditions of 5% $CO_2$; 1 uCi of [3H]thymidine (ICN Biochemical's, Costa Mesa, Calif.) is added to each well, and the cells are incubated for an additional 24 h. Cells were harvested onto glass fiber filters, and [$^3$H]thymidine uptake is quantitated by liquid scintillation counting. For each mutant toxin, PBMCs from at least three distinct donors are used.

Flow cytometry of PBMCs. PBMCs ($10^6$) from healthy donors are incubated with toxins at a concentration of 1 µg/ml for 4 days. Cells were harvested, washed three times with PBS, and applied to a FACScan flow cytometer (Becton Dickinson).

Cell lines. L-cell transfectants L66 (vector only) and L54.1 (DQ(33/DQa2) are the generous gift of Robert Karr, Monsanto Company. Transfectants were maintained in suspension in petri dishes in Dulbecco modified Eagle medium (DMEM) with 10% PCS, 2 mM L-glutamine, 100 U of penicillin per ml, 100 fig of streptomycin per ml, and 250 µg of the neomycin analog G418 per ml for selection. Before use, transfectants are examined by fluorescence-activated cell sorting analysis with fluorescein isothiocyanate-labeled anti-HLA-DQ3 (KS13) to confirm the expression and surface localization of the DQ molecule. Antibody KS13 is the generous gift of Soldano Ferrone, New York Medical College, Valhalla, N.Y.

Radiolabeled rSPEA binding assays. rSPEA is iodinated by using chloramine-T (Sigma). One hundred µg of toxin was incubated with 0.5 mCi of $Na^{125}I$ and 5 µg (5 mg/ml) of chloramine-T in 100 µg of 100 mM Tris-150 mM NaCl (pH 7.4) for 10 min. The reaction is terminated by the addition of 20 µl (5 mg/ml) of sodium metabisulfite (Sigma). Labeled toxin was separated from unincorporated radioactivity on a 1-ml Sephadex G-25 column, which had been preequilibrated with PBS. The Kd of rSPEA-DQ interaction is determined by incubating $10^6$ L54.1 cells (expressing class II MHC) with various concentrations of ml-rSPEA in a total volume of 100 µg of DMEM-10% FCS-0.1% sodium azide. Nonspecific binding is estimated by incubating separate tubes with unlabeled competitor toxin at a concentration 100 times greater than that of labeled toxin. Cells are incubated at 37° C. for 4 h with agitation every 20 min and then pelleted through an oil gradient (80% dibutyl phthalate, 20% olive oil). Pellets are cut from the tubes, and cell-associated $^{125}I$ was measured on a gamma counter.

K determinations are evaluated in a similar fashion except that additional tubes containing various concentrations of 125I-rSPEA plus unlabeled mutant competitor are analyzed. Lineweaver-Burk plots of the reciprocal of toxin bound versus toxin free are used to determine inhibition constants.

Structure of SPEA. Predicted ribbon structure of SPEA was generated by the Swiss Model Automated Protein Modelling Server, Glaxo Institute for Molecular Biology, Geneva, Switzerland. Primary amino acid sequence of SPEA is modeled on the crystal structures of staphylococcal enterotoxin A (SEA) and staphylococcal enterotoxin E (SEE). Crystal coordinates for SEA and SEE are from the Brookhaven Database Crystal Coordinates and are deposited by Swaminathan and Sax. Structure is viewed by using the Raswin Molecular Graphics Viewer software, version 2.4, 1994 (R. Sayte, Department of Computer Science, University of Edinburgh, Edinburgh, United Kingdom).

Isolation and Purification of SSA is by the method of Mollick J et al, *J. Clin. Invest.* 92: 710-719 (1993) and Reda K et al, *Infect. Immun.* 62: 1867-1874 (1994)

Purification of SSA from *S. pyogenes* strain Weller. Because RDA has been used to purify several staphylococcal enterotoxins, this material is useful in identifying novel *S. pyogenes* superantigens. Concentrated culture supernatants from strain Weller are chromatographed on a RDA column, the column was eluted with a phosphate step gradient, and fractions are tested for the presence of a class II-dependent T cell mitogen. We identify such an activity eluting between 60 and 150 mM P04, corresponding approximately to fraction numbers 8-55. This activity elutes in a broad peak and does not correspond to a detectable protein peak. Examination of an aliquot of the pooled activity by SDS-PAGE gel reveals many proteins, some in the 30-kD range. The pooled active fractions are fractionated from the RDA column by gel filtration (G-75) and anion exchange chromatography and active fractions from each column are selected. The product from the final chromatography step consists predominantly of three proteins. The proteins are blotted to a solid support and analyzed by NH2-terminal sequencing. The higher $M_r$ protein is identified as SP and/or SPE-B. These two proteins are closely similar and are not distinguished based on the 29 amino acids sequenced. The lower $M_r$ protein, $-27$ kD in size, yields a 59-amino acid NH2 terminus that is not notably homologous to any previously characterized protein. The middle band (28 kD) displays an NH2 terminus strikingly similar to the NH2 termini of SEB, SEC, and SEC3 and dissimilar to M protein. The 28-kD molecule with the SEB-like NH2 terminus is designated SSA.

Purification of SSA by Ab affinity chromatography. To determine whether or not SSA is responsible for the superantigen activity, our efforts are directed to its purification. An anti-peptide antiserum is raised against the first 19 amino acids of SSA. To determine the ability of the anti-SSA Abs to bind native SSA, a concentrated streptococcal supernatant from 16 liters is chromatographed on RDA in an effort to enrich for SSA. The RDA eluate is passed over the anti-SSA Ab column and the column eluted. Examination of the eluate by SDS-PAGE gel, and silver stain shows one prominent band at 28 kD, and two minor bands, one at $-25$ kD and one at $-12$ kD. NH2-terminal sequencing of the 28-kD product shows the SSA NH2 amino terminus. To determine whether the lower $M_r$ species were contaminants or SSA degradation products, an identical sample is subjected to immunoblot analysis. Anti-SSA antibodies detect all three species shown in the silver stain gel, indicating that these lower molecular weight bands are breakdown products of the 28-kD protein. Because the antibodies are directed against the NH2 terminus, these products likely represent SSA molecules missing COOH terminal sections.

PCR amplification and cloning of the 5' half of SSA from Weller genomic DNA. Nondegenerate, nonoverlapping oligonucleotides (SSA1,5'-AGTCAACCAGATC-CTACGC-CAG AACAATTGAA-3'; SSA2,5'-AAATC-GAGTCAATT-TAC GGAGTTATGGCC-3') are designed on the basis of the SSA N-terminal protein sequence with a bias toward SEB codon usage. We hypothesized that SSA may retain homology to SEB in regions further downstream from the 24 N-terminal residues, especially in regions relatively conserved among all known staphylococcal and streptococcal superantigens. In order to amplify SSA from Weller genomic DNA with PCR, we pair each SSA oligonucleotide with an oligonucleotide (SEB7, residues 658 to 675) specific for a region in SEB immediately downstream of the disulfide loop. Weller genomic DNA (200 ng) is combined with 50 pmol each of sense (SSA1 or SSA2) and antisense (SEB7) primers, a 200 µl concentration of each deoxynucleoside triphosphate, and 10 µl of 10×Pfu polymerase buffer 1 (Stratagene) in a total volume of 100 ul. Reaction mixtures are overlaid with 100 µL of mineral oil and denatured at 95° C. for 7 min before Pfu polymerase (2.5 units) (Stratagene) is added. PCR conditions were as follows: 1 min at 95° C., 2 min at 37° C., and 3 min at 72° C. for 25 cycles in a thermocycler (Perkin-Elmer Corp., Norwalk, Conn.). Combinations of SSA1 or SSA2 with SEB7 specifically amplified products of approximately 340 or 310 bp, respectively, from strain Weller genomic DNA, but not from strain Gall DNA, which does not produce SSA, PCR products were ligated to the pBluescript SK– vector to make pKR1 and pKR2, which are used to transform XL-1 Blue *E. coli*. Nucleotide sequence analysis of pKR1 and pKR2 inserts predicted amino acid sequences identical to that determined by N-terminal protein sequencing of native SSA from strain Weller *S. pyogenes* (39).

Subcloning and expression of recombinant SSA. The nucleotide sequence encoding the mature form of SSA is PCR amplified from Weller genomic DNA with flanking primers and digested with Hindi and Spel, which cut 46 bp upstream and 33 bp downstream, respectively, of the SSA open reading frame. This fragment was ligated to the pBluescript II KS expression vector (Stratagene) to make pKR4. An XL-1 Blue *E. coli* strain carrying pKR4 was grown to an optical density at, 600 nm of 1.0 and induced to express SSA by the addition of IPTG (isopropyl-β-D-thiogalactopyranoside) to a final concentration of 0.1 mM. After further incubation at 37° C. with shaking for 3 h, bacteria were harvested by centrifugation and resuspended in TE, pH 8.0. An aliquot of cells was then mixed with an equal volume of SDS sample buffer, and the whole cell lysate was analyzed by SDS-polyacrylamide gel electrophoresis (SDS-PAGE) and SSA immunoblot analysis. Lysates of *E. coli* strains carrying pMV7 or pBluescript, containing seb or no insert in the multicloning cassette, respectively, were processed in parallel as positive and negative controls. Uninduced whole cell lysates were also examined.

Identification and Characterization SMEZ, SMEZ2, SPE-G, SPE-H and SPE-J is given in Profit T et al. *Exp. Med.* 189: 89-101 (1999).

Identification of Novel SAgs. The novel SAgs are identified by searching the *S. pyogenes* Ml genome database at the University of Oklahoma with highly conserved β5 and α4 regions of streptococcal and staphylococcal SAgs, using a TBlastN search program. The ORFs are defined by translating the DNA sequences around the matching regions and aligning the protein sequences to known SAgs using the computer program Gap. Multiple alignments and dendrograms are performed with Lineup and Pileup. We used the FAST A program for searching the SwissProt (Amos Bairoch, Switzerland) and PIR (Protein Identification Resource) protein databases. The leader sequences of SPE-G and SPE-H are predicted using the SP Scan program. All computer programs are part of the Genetics Computer Group package (version 8).

Cloning of smez, smez-2, spe-g, and spe-h. 50 ng of *S. pyogenes* Ml (ATCC 700294) or *S. pyogenes* 2035 genomic DNA is used as a template to amplify the smez DNA fragment and the smez-2 DNA fragment, respectively, by PCR using the primers smez-fw (TGGGATCCTTA-GAAGTA-GATAATA) and smez-rev (AAGAATTCTTAG-GAGT-CAATTTC) and Taq Polymerase (Promega Corp.). The primers contain a terminal tag with the restriction enzyme recognition sequences BamHI and EcoRI, respectively. The amplified DNA fragment, encoding the mature protein without the leader sequence is cloned into a T-tailed pBlueScript™ SKII vector (Stratagene).

Spe-g and spe-h are cloned by a similar approach, using the primers

```
spe-g-fw
(CTGGATCCGATGAAAATTTAAAAGATT-TAA)
and spe-g-rev
(AAGAATTCGGGGGGAGAATAG),
and spe-h-fw
(TTGGATCCAATTCTTATAATACAACC)
and spe-h-rev
(AAAAGCTTTTAGCTGATTGACAC),
``` respectively.

The DNA sequences of the subcloned toxin genes are confirmed by the dideoxy chain termination method using a Licor automated DNA sequencer (model 4200). As the DNA sequences from the genomic database are all unedited raw data, three sub-clones of every cloning experiment are analyzed to insure that no Taq polymerase-related mutations were introduced. The DNA sequence of the smez-2 gene has been annotated in EMBL/Genbank/DDBJ under accession number AF086626.

Expression and Purification of rSMEZ, rSMEZ-2, rSPE-G, and rSPE-H. Subcloned smez, smez-2, and spe-g fragments are cut from pBlueScript™ SKH vectors, using restriction enzymes BamHI and EcoRI (GIBCO BRL), and cloned into pGEX-2T expression vectors (Pharmacia Biotech). Due to an internal EcoRI restriction site within the spe-h gene, the pBlueScript:spe-h subclone is digested with BamHI and HindIII and the spe-h fragment is cloned into a modified pGEX-2T vector that contains a HindIII 3' cloning site. rSMEZ, rSMEZ-2, and rSPE-H are expressed in *Escherichia coli* DH5a cells as glutathione-5-transferase (GST) fusion proteins. Cultures are grown at 37° C. and induced for 3-4 h after adding 0.2 mM isopropyl-p-D-thiogalactopyranoside. GST-SPE-G fusion protein is expressed in cells grown at 28° C. The GST fusion proteins are purified on glutathione (GSH) agarose and the mature toxins are cleaved off from GST by trypsin digestion. All recombinant toxins, except rSMEZ, were further purified by two rounds of cation exchange chromatography using car-boxy methyl sepharose (Pharmacia Biotech). The GST-SMEZ fusion protein is trypsin digested on the GSH-column and the flow-through containing the SMEZ is collected.

Gel Electrophoresis. All purified recombinant toxins are tested on a 12.5% SDS-polyacrylamide gel according to Laemmli's procedure. The isoelectric point of the recombinant toxins is determined by isoelectric focusing on a 5.5% polyacrylamide gel using ampholine, pH 5-8 (Pharmacia Biotech). The gel is run for 90 min at 1 Watt constant power.

Toxin Proliferation Assay. Human PBLs are purified from blood of a healthy donor by Histopaque Ficoll (Sigma Chemical Co.) fractionation. The PBLs are incubated in 96-well round-bottomed microtiter plates at $10^5$ cells per well with RPMI-10 (RPMI with 10% PCS) containing varying dilutions of recombinant toxins. The dilution series is performed in 1:5 steps from a starting concentration of 10 ng/ml of toxin. After 3 d, 0.1 1 wCi[$^3$H]thymidine is added to each well and cells are incubated for another 24 h. Cells are harvested and counted on a scintillation counter. Mouse leukocytes are obtained from spleens of five different mouse strains (SJL, B10.M, B10/J, C3H, and BALB/c). Splenocytes are washed in DMEM-10, counted in 5% acetic acid, and incubated on microtiter plates at $10^5$ cells per well with DMEM-10 and toxins as described for human PBLs.

TCR Vβ Analysis. Vβ enrichment analysis is performed by anchored multiprimer amplification. Human PBLs are incubated with 20 pg/ml of recombinant toxin at $10^6$ cells/ml for 3 d. A twofold volume expansion of the culture followed with medium containing 20 ng/ml IL-2. After another 24 h, stimulated and resting cells are harvested and RNA is prepared using Trizol reagent (GIBCO BRL). A 500 bp βchain DNA probe is obtained by anchored multiprimer PCR, radiolabeled, and hybridized to individual Vβ5 and a Cβ DNA region dot-blotted on a Nylon membrane. The membrane is analyzed on a Storm PhosphorImager using ImageQuant software (Molecular Dynamics). Individual Vβs are expressed as a percentage of all the Vβs determined by hybridization to the Cβ probe.

Jurkat Cell Assay. Jurkat cells (a human T cell line) and LG-2.cells (a human B lymphoblastoid cell line, homozygous for HLA-DR1) are harvested in log phase and resuspended in RPMI-10. 100 ul of the cell suspension, containing $10^5$ Jurkat cells and $2 \times 10^4$ LG-2 cells are mixed with 100 μl of varying dilutions of recombinant toxins on 96-well plates. After incubating overnight at 37° C., 100-^1 aliquots are transferred onto a fresh plate and 100 μl ($10^4$) of Sel cells (IL-2-dependent murine T cell line) per well are added. After incubating for 24 h, 0.1 1 μCi[$^3$H]thymidine is added to each well and cells are incubated for another 24 h. Cells were harvested and counted on a scintillation counter. As a control, a dilution series of IL-2 is incubated with Sel cells.

Computer-aided Modelling of Protein Structures. Protein structures of SMEZ2, SPE-G and SPE-H are created on a Silicon Graphics computer using Insight11/Homology software (Biosym Technologies). The SAgs SEA, SEB, and SPE-C are used as reference proteins to determine structurally conserved regions (SCRs). Coordinate files for SEA (1ESF), SEB (1SEB), and SPE-C (1AN8) are downloaded from the Brookhaven Protein Database. The primary amino acid sequences of the reference proteins and SMEZ-2, SPE-G, and SPE-H, respectively, are aligned, and coordinates from superimposed SCRs are assigned to the model proteins. The loop regions between the SCRs are generated by random choice. MolScript software is used for displaying the computer-generated images.

Methods of isolation and characterization of SPEC is carried out by the methods of Li P L et al., J. Exp. Med. 186: 375-383 (1997)

Toxin Purification. All toxins are expressed from the pGEX vector in *Escherichia coli* as glutathione S transferase (GST) fusion proteins and purified by glutathione chromatography. Mature toxins are cleaved from GST by trypsin digestion and purified by two rounds of cation exchange chromatography. The first round uses carboxymethyl sepharose and the second on a POROS HS (Perceptive Systems, Cambridge, Mass.) HPLC column. All toxins are resistant to trypsin digestion except SEB which has a single cleavage site in the disulphide loop region. This does not affect SEB activity.

Toxin Proliferation Assays. Human peripheral blood lymphocytes are purified by Ficoll-Hypaque and incubated for 3 d at 106 cells/ml in duplicate in 96-well microtiter plates in media containing varying dilutions of recombinant toxins. 0.1 fid [3H]thymidine is added to each well, and cells were incubated a further 24 h. Plates are harvested and counted on a scintillation counter.

TCR Vβ Analysis. These are performed using the reverse dot-blot procedure. In brief, human peripheral blood lymphocytes are incubated with 1 ng/ml of recombinant toxins for 3 d. The cultures are expanded twofold with medium containing 20 ng/ml IL-2. Cells are harvested at 4 d and RNA made by standard procedures. TCR β-chain messenger is reverse transcribed using a set of primers specific for a conserved region in all β-chain genes. Amplification of a 500-bp Vβ probe is accomplished by an anchor primer to the 5' end of the β-chain primers plus a single Cβ region primer. This probe is radiolabeled and reverse blotted to filters containing individual β-chain genes. Relative changes in individual β-chain mRNA are compared to unactivated PBL.

Anti-TCR mAb FACS Staining. Activated T cells are incubated for 1 h on ice with 25 ml of anti-TCR BV2 (MPB2/C11; a gift from A. W. Boylston, University of Leeds, Leeds, UK), anti-BV551 (LC4; a gift from R. Levy, Stanford University Medical School, Stanford, Calif.), anti-BV5S3 (42/1C1; a gift from A. W. Boylston, University of Leeds, Leeds, UK), anti-BV8.1 (C305; a gift from A. Weiss, University of California, San Francisco, Calif.), and anti-BV12S (S511; a gift from D. Posnett, Cornell University Medical College, NY). Washed cells are then incubated with 1 ml FITC goat anti-mouse (Becton Dickinson) and incubated on ice for a further 30 min. After washing, cells are analyzed on a FACSCAN®.

Zinc Blots. Recombinant toxins (10 (μg) are incubated in triplicate with 10 μg EDTA followed by 100 μg 65ZnCl (New England Nuclear, Boston, Mass.) in 20 mM Tris, pH 8.0, 10 mM MgCl2, 0.15 M NaCl made zinc free by addition of chelex resin (Sigma Chemical Co.). Samples are then dot blotted to nitrocellulose filters using a 96-well dot-blot apparatus. Filters are washed briefly three times with zinc-free buffer, and then autoradiographed. Spots are cut out and counted on gamma counter (Packard Instrs., Meriden Conn.) to quantify 65Zn bound to each toxin.

Nondenaturing SDS Electrophoresis. Toxin samples are incubated in standard Laemmli reducing sample buffer (containing 1% SDS and 10 mM dithiothreitol), and then resolved as normal of a 12.5% acrylamide gel. For denaturing conditions, samples are heated to 100° C. for 2 min before loading. To prevent dimers from dissociating during running, the power is maintained below 2 W (20 mA and 100 V). Some reduced samples are treated with 20 mM iodoacetic acid, pH 7.0, before loading. EDTA is added to some samples at 10 mM. incubation at 37° C. as the percentage of LG-2 cells in aggregates, and is determined by light microscopy.

Western Blotting of *S. pyogenes* Strain 2035-de-rived SPE-C. *S. pyogenes* strain 2035 is grown under anaerobic conditions in brain heart fusion medium at 37° C. for 24 h without shaking. Supernatant proteins are concentrated by sequential $(NH_4)_2SO_4$ precipitations, with cuts of <40%, 40-60% 60-80%, and 80% saturation, and resuspended in 50 mM Tris-1 mM EDTA, pH 7:4, at 500-1,000 times their original concentration. Recombinant SPE-C or 10 ul of the 60-80% $(NH_4)_2SO_4$-precipitable fraction supernatant are combined with an equal volume of nonreducing 2% SDS sample buffer and separated by 0.1% SDS-12% PAGE. Denatured samples are heated (95° C.) for 2 min before analysis. Fractions are dialyzed extensively against 25 mM Tris-50 mM NaCl-1 mM EDTA, pH 7.4, to remove salt. After separation by SDS-PAGE, proteins are transferred to a nitrocellulose filter (Hybond-C; Amersham Corp., Arlington Heights, 111.) in an electroblotting apparatus 8.5-150 mM glycine-10% methanol). The filter is blocked in PBS-0.05% Tween-5% nonfat dried milk powder-0.1%) normal rabbit serum and stained with 1:6,000 peroxidase-labeled affinity-purified rabbit and-SPE-C immunoglobulin. The peroxidase conjugate is detected on radiographic film by chemiluminescence (ECL; Amersham Corp.) according to the manufacturer's instructions.

Size Exclusion Chromatography. Recombinant SPE-C. (2 mg/ml) is dialyzed at 4° C. overnight in 20 mM BisTris-Tris, pH 6.0 or 9.0. 20 µl samples are diluted into 100 µl 50 mM BisTris, pH 6.0, 7.0, 8.0, or 9.0/0.1 M NaCl and incubated for 1 h at room temperature before separation at 1 ml/min (±0.05 ml/min) on a Superose12 (Pharmacia) high resolution HPLC column attached to a Biocad Sprint (Perceptive Systems) preequilibrated with the respective incubation buffer. Trace chromatograms monitoring $Abs_{280\ nm}$, pH, and conductivity are all recorded directly and subsequently analyzed for retention times, peak integration, and peak assignment using the on-line Biocad software. Traces are grouped and printed using the stacked trace mode which automatically aligns each trace to the injection point Identification and Characterization of the Staphylococcal enterotoxins SEG, SEH, SEI, SEJ, SEK, SEL, SEM is carried out by the method of Jarraud S J Clinical Microbiology (1999).

Strains. S MJB1316 (a gift from Sibyl Munson, University of Wisconsin, Madison, Wis.), an RN450 derivative that contains the cloned seg gene on the staphylococcal expression vector pRN5548, is used as SEG positive control. The following S. aureus strains were used to check the specificity of PCR amplification: FDA-S6 (ATCC 13566 (sea+ seb+)), FRI-137 (ATCC 19095 (sec+, seg+, seh+, sei+)), FRI-1151 m (sed+), FRI-326 (ATCC 27664 (see+)), FRI-569 (ATCC 51811 (seh+)), FRI-1169 (tst+), TC-7 (eta+, seg+, sei+), and TC-146 (etb+ seg+ sei+). Two hundred thirty S. aureus clinical isolates are collected. They are isolated from 58 patients with S. aureus infection (arthritis, skin infection, pneumonia, or infective endocarditis), 102 patients with acute toxemia (TSS, SSF, or SSSS), and 70 asymptomatic nasal carriers. All strains are collected from hospitals located throughout France and are identified as S. aureus by their ability to coagulate citrated rabbit plasma (bioMerieux, Marcy-l'Etoile, France) and to produce a clumping factor (Staphyslide Test; bioMerieux). Escherichia coli TGI is used for plasmid amplification and genetic manipulations.

DNA amplification and sequencing DNA is extracted from A900322 cultures and used as a template for amplification with primers sei-1 and seg-2. Primers wsei and wseg are designed following identification of suitable hybridization sites in the sei and seg genes and were compatible with the Clontech Genome Walker kit (Ozyme; Montigny-Le Bretonneux, France), which is suitable for cloning unknown DNA sequences adjacent to a known sequence. This kit is used, according to the supplier's instructions, to identify sei and seg flanking regions using primers hindlll and wsei on a HindIII chromosomal digest for the amplification of the sei-upstream region; and primers hpa1 and wseg on an Hpa1 chromosomal digest for the amplification of the SEG-downstream region. PCR products are analyzed by electrophoresis through 0.8% agarose gels (Sigma, St. Louis, Mo.), purified using the High Pure PCR Product Purification kit (Boehringer Mannheim, Meylan, France), and sequenced (Genome Express, Grenoble, France). Sequences are compiled, analyzed, and compared using Blast (http://www.ncbi.nlm.nih.gov/BLAST), Gene-Jokey, and ClustalX software (European Bioinformatics Institute, Cambridge, U.K., http://www.ebi.ac.uk).

Toxin-gene detection. Sequences specific for sea-e, seg-i, tst, eta, and etb, encoding SEA-E, SEG-I, TSST-1, ETA, and ETB, respectively, are detected by PCR. DNA from clinical isolates is extracted from cultures and used as a template for amplification with the primers described in Table 1 (Eurogentec, Seraing, Belgium). Table 1 of primers used is given-in Jarraud et al., J. Clin. Micro. (1999). Amplification of gyrA is used as a control to confirm the quality of each DNA extract and the absence of PCR inhibitors. All PCR products are analyzed by electrophoresis through 1% agarose gels (Sigma).

Detection of bacterial RNA by RT-PCR. Total RNA is extracted from staphylococcal cultures by using RNeasy spin columns (Qiagen, Courtaboeuf, France). cDNA is synthesized using Ready-To-Go RT-PCR beads (Pharmacia Biotech, Orsay, France) by incubating 0.1 µg of total RNA with the following pairs of primers (primer 5', sel3), (sel-4, sel-5), (sel 1, sel2), (invsel2, invsem1), (semi, invsei1), (sei1, sei2), (invsei2, ψent2), (ψent1, invsek 1), (sek1, sek2), (invsek2, invseg1), (seg1, seg2), (invseg2, primer 3'). The reaction mixtures are incubated with each primer pair described above, at 42° C. for 30 min for reverse transcription, followed by 30 cycles of amplification (1-min denaturation at 94° C. 1-min annealing at 55° C., and 1-min extension at 72° C.). The RT-PCR products are then analyzed by electrophoresis through 1% agarose gel. RNA extracts are tested for DNA contamination by preincubating the reaction mixtures at 95° C. for 10 min to inactivate reverse transcriptase before the RT-PCR.

Production and purification of recombinant enterotoxins. Primers are designed following identification of suitable hybridization sites in sel, sem, sei, sek, and seg. The 5' primers are chosen within the coding sequence of each gene, omitting the region predicted to encode the signal peptide, as determined by hydrophobicity analysis according to Kyte and Doolitttle with GeneJockey software and SignalP VI.1 World Wide Web Prediction Server (www.cbs.d-tu.dk/services/SignalP/); the 3' primers are chosen to overlap the stop codon of each gene. A restriction site is included in each primer. DNA is extracted from A900322 or MJB1316 and used as a template for PCR amplification. PCR products and plasmid DNA are prepared using the Qiagen plasmid kit. PCR fragments were digested with EcoRI and PstI (Boehringer Mannheim) and ligated (T4 DNAligase; Boehringer Mannheim) with the pMAL-c2 expression vector from New England Biolabs (Ozyme) digested with the same restriction enzymes. The resulting plasmids are transformed into E. coli TG 1. The integrity of the ORF of each construct is verified by DNA sequencing of the junction between pMAL-c2 and the different inserts. The fusion proteins are purified from cell lysates of transfected E. coli by affinity chromatography on an amylose column according to the supplier's instructions (New England Biolabs).

T cell proliferation assays. PBL from healthy donors are cultured in 24-well plates ($10^6$ cells/well) in RPM 11640 medium supplemented with 8% pooled human serum and 10 fig/ml recombinant staphylococcal toxin. rIL-2 (50 IU/ml) is added on day 5. When necessary, T cell cultures are diluted in IL-2-supplemented medium until TCR analysis. For controls T cells from the same donors that are stimulated with 0.5 µg/ml Phaseolus vulgaris leucoagglutimn (PHAL) (Sigma) are used.

Flow cytometry. The following mAb (mAb; specificity indicated in brackets) are used for flow cytometry: E2.2E7.2

(Vβ2), LE89 (Vβ3), IMMU157 (Vβ5.1), 3D11 (Vβ5.3), CRI304.3 (Vβ6.2), 3G5D15 (Vβ7), 56C5.2 (V8.1/8.2), FIN9 (Vβ9), C21 (Vβ11), S511 (Vβ12), IMMU1222 (Vβ13.1) JIJ74 (Vβ13.6), CAS1.1.13 (Vβ14), Tamaya1.2 (Vβ16), E17.5F3 (Vβ17), BA62.6 (Vβ18), ELL1.4 (Vβ20), IG125 (Vβ21.3), IMMU546 (Vβ22), and HUT78.1 (Vβ23). These mAb, and CD4- and CD5-specific mAb, is purchased from Beckman/Couker/Immunotech (Marseille, France). Cells are phenotyped by indirect immunofluorescence, as described previously. Briefly, cells are incubated with unconjugated mAb for 30 mm at room temperature, then washed and incubated with FITC-conjugated rabbit anti-mouse Ig antiserum (BioAtlantic, Nantes, France) for 30 min on ice. After washing, cells are analyzed by flow cytometry on a FACScan apparatus (Becton Dickinson, Mountain View, Calif.) using the LYSYS II software package on a FACstation.

Immunoscope analysis. Total RNA is extracted using the Tnzol reagent (Life Technologies, Gaithersburg, Md.). TCR (3-chain-specific primers are as described previously, and reverse transcription, PCR amplification, and run-off steps are performed as reported previously. Fluorescent DNA products are loaded on a sequencing gel and analyzed with the Immunoscope software.

Identification of the SEG and SEI flanking regions. When this work was initiated, the coding regions of only seg and sei were available, and the two genes were known to be in tandem orientation, separated by a 1.9-kb DNA fragment in S. aureus strain A900322. A 3.2-kb fragment is thus amplified by PCR with primers sei1 and seg2 and was then sequenced. The intergenic 1.9-kb DNA sequence contains three open reading frames (ORF1, 2, and 3) of 399, 327, and 777 bp, respectively. Comparison of the deduced amino acid sequences of these ORFs with translated sequences from GenBank showed that the putative proteins corresponding to these ORFs had substantial sequence similarities to known SEs: ORF1 exhibited homology to the N-terminal region of SEB; ORF2 to the C-terminal region of SEC; and ORF3 to SEA. The PCR "walking" strategy is chosen to identify the seg and sei flanking regions. The use of primers wsei and hindlll on Hindlll digests amplifies and allows sequencing of the 3.2 kb of DNA upstream of sei. Analysis of this sequence showed two significant ORFs (ORF4 and ORF5) of 783 and 720 bp, respectively. ORF4 exhibited homology with SEJ, and ORF5 with SEI. The use of primers wseg and hpa1 on Hpa1 digests amplified a 0.8-kb fragment downstream of seg. Sequence analysis of this fragment reveals no other significant ORFs. The concatenated sequence of seg-sei-intergenic, -upstream and -downstream regions is validated by sequencing a 6.189-kb PCR fragment encompassing the whole region. Although sei in strain A900322 is 100% homologous with the sequence deposited in GenBank (accession number AF064774), seg in strain A900322 showed one mutation, corresponding to a Leu→Pro substitution at position 29. This new variant is designated SEGL29P. ORFs 1-5 are homologous but not identical with any known enterotoxins hence they corresponded to new enterotoxins. However, ORF1 and 2 are at least 50% shorter than any of the known enterotoxins. ORF-1 possesses a satisfactory Shine-Dalgarno (SD) sequence (TG-GAGT-N7-AUG, consensus AGGAGG-N6/10-AUG) but, in comparison with SEB, to which it is highly related, shows a large deletion of its 3' end, which corresponds to a region that is essential for biological (superantigenic) activity. ORF2 has neither an SD sequence nor a signal peptide, and resembles an N-terminal-truncated SEC. Accordingly, ORF1 and 2 are designated ψent1 and ψ2, respectively, meaning they represent pseudogenes with no likely biological function. In contrast, ORFs 3, 4, and 5 have sizes consistent with active enterotoxin-like molecules. ORF5 possesses a satisfactory SD sequence and translation start site, whereas ORF3 and ORF4 have an adequate SD sequence in front of a nonca-nonical, although suitable, translation start site (ATT) coding the thiamine. Thus. ORF3, ORF4, and ORF5 are designated sek, sel, and sem, respectively. Thus, the 6301-bp DNA region identified contains seg and set plus three potential enterotoxin genes (sek, sel, and sem) and two pseudogenes (ψent1, ψent2), all in the same orientation. We designated this region egc for "enterotoxin gene cluster." With the exception of plasmid pIB485, which contains SED and SEJ in opposite orientations separated by 895 nucleotides, and the staphylococcal pathogenicity island, which contains tst and ent separated by 10.234 kb, no such gene cluster organization has been previously described for enterotoxin genes.

Transcriptional analysis. To investigate whether this seg transcript was polycistronic, i.e., encoded one or more of the ORFs identified in egc, c-DNA is generated from strain A900322 total RNA by reverse transcription and amplified by PCR using primer pairs located within each gene and bracketing adjacent genes. Abundant RT-PCR products (B to K) of the expected size are obtained using the corresponding primer pairs. In contrast, no RT-PCR product A (primer 5', sei3) nor L (primer invseg2 and primer 3') is obtained. These results suggest that the seven genes and pseudogenes composing egc are cotranscribed, and that the 5' and 3' ends of the transcript must be close to the beginning of sel and to the end of seg, respectively. Sequence analysis reveal putative −10 and −35 promoter sequences (TTGTCT-N15-TAATTT-N134-ATT) upstream of the sel start codon. The 3' end may lie at an inverted repeat at position 6018-6067, which is a potential transcription termination signal, 5830 nucleotides downstream of the putative transcription start site. These results suggest that egc is an operon.

Superantigen activity. The association of related genes that are cotranscribed suggested that the resulting peptides might have complementary effects on the host's immune response. One hypothesis is that gene recombination created new variants of toxins differing by their superantigen profiles. Purified recombinant SEL, SEM, SEI, SEK, and SEGL29P expressed in E. coli are studied for their ability to induce selective expansion of T cells bearing particular TCR Vβ regions in short-term PBL culture. As shown in Tables III and IV, recombinant SEL SEM, SEI, and SEK consistently induces selective expansion of distinct sets of Vβ subpopulations. By contrast. SEGL29P fails to trigger expansion of any of the 23 β subsets. The sum of results obtained with each of these recombinant toxins globally corresponds to the selective expansion of Vβ subpopulations induced by crude supernatant of staphylococcal culture of strains that harbored egc (data not shown). This suggests that the maltose-binding protein portion of the fusion toxins do not significantly influence the Vβ specificity of these superantigens. To investigate whether the L29P mutation could explain the lack of superantigen activity, a rSEG with an L29 codon is constructed from S. aureus strain MJB1316 (which contains the cloned seg on a plasmid) and then expressed in E. coli, and the superantigen activity of this toxin is tested. SEGL29. induces selective expansion of Vβ14 and, to a lesser extent, Vβ13.6, OT cells. The L29P mutation thus accounts for the complete loss of superantigen activity. Computer modeling of the two-dimensional structure of the wild-type and mutated proteins reveals no major conformational differences between the two proteins. It is likely that L29 is located at a position crucial for proper superantigen/MHC II interaction. In addition to the selective expansion of TCR Vβ subsets observed with the different toxins, flow cytometry reveals preferential expansion of CD4 T cells in SEI and SEM cultures. By contrast, the CD4/CD8 ratios in SEK-, SEL-, and SEG-stimulated T cell lines are close to those in fresh PBL. This phenomenon, which is observed with cells from several donors, reflects a variable contribution of the CD4 coreceptor to the T cell activation process, depending on the affinity of the TCR for the superantigen/MHC complex. To document the TCR Vβ composition of superantigen-stimulated T cell lines and the clonal diversity of the expanded TCR Vβ subsets, the size distribution of PCR-amplified TCR β-chain junctional products is studied using the Immunoscope technique. Results of this molecular analysis are in good overall agreement with those obtained by flow cytometry, as similar dominant TCR Vβ subsets are identified with the two approaches. Additionally, Immunoscope analysis shows that the complementarity-determining region 3 size distribution of TCR β-chain junctional transcripts within expanded Vβ subsets is pseudogaussian in all superantigen-stimulated cultures, reflecting a high level of polyclonality. This is further confirmed by sequence analysis of TCR β junctional transcripts derived from some expanded TCR Vβ subsets. Taken together, these TCR repertoire studies confirm the superantigenic nature of the new toxins identified in this study.

Example 11

Construction of Adenovirus Vectors with Insertions for Superantigens

Superantigens are inserted into human adenoviruses (Ads) which are used as live viral vector for expression of superantigens in mammalian cells. Adenoviruses vectors are exemplified here for insertion of the superantigen nucleotide. A mutant adenovirus with selectivity for P53 deficient tumors is preferred such as ONYX-015. An efficient and flexible system for construction of adenoviral vector with insertions or deletions in early regions 1 and 3 as described by Bett A J et al., Proc. Natl. Acad. Sci. 91: 8802-8806 (1994) is given below. Similar procedures insertion of the superantigen gene would be applied to the ONYX-014 mutant.

Principle of Method: Superantigen genes are inserted into adenoviral vectors using the following principles and methods adapted from Bett, A J et al., *Proc. Nat. Acad. Sci.* 91: 8802-8806 (1994). Additional methods are given in a book titled Adenovirus Methods and Protocols Wold, WSM ed. Humana Press, Totowa, N.J. (1999) which is incorporated in entirety by reference. These methods involve insertion of the superantigen DNA either by overlap recombination or by ligation insertion. The method exemplified below for insertion of SAg sequences uses the Ad5DNA virus but may be adapted to the dll 150 or ONYX-015 mutant or any other adenovirus. The Ad5 DNA sequences are cloned into bacterial plasmids. Deletions are made in the early region 1 and (3180 bp) and early region 3 (2690 or 3132 bp) and are combined in a single vector that have a capacity for inserts of up to 8.3 kb, enough to accommodate the majority of cDNAs encoding proteins with regulatory elements. SAg genes are, inserted into either early region 1 or 3 or both and mutations or deletions are readily introduced into the viral genome. SAg genes may be inserted into areas of the viral genome that have been inactivated or deleted and considered to be non-essential to the lytic activity of the virus or its ability to evade the host immune response. Both Ad and HSV carry genes that are not essential for viral replication and these may be utilized for SAg insertion.

The first step is the construction of AdBHG, a virus that contains the Ad5 genome with the deletion of E3 sequences from by 28,133 to 30,818 and the insertion of a restriction enzyme site. The next step is the generation of a bacterial plasmid containing the entire AdBHG genome and subsequent identification of infectious clones. Baby rat kidney (BRK) cells are infected with AdBHG under conditions that result in the generation of circular Ad5 genomes. At 48 h after infection, DNA is extracted from the infected BRk cells and used to transform *E. coli* HMS174 to ampicillin and tetracycline resistance. Plasmids with the complete AdBHG genome are selected. The final step is the generation of the pBHG1O by deleting the packaging signals in pBHG9 by partial BamHI digestion and relegation. A Pac I restriction enzyme site unique to this plasmid is present between Ad5 bp 28,133 and by 30,818 to permit foreign gene insertion. Because the packaging signal is deleted, pBHG10 is noninfectious but cotransfections with plasmids that contain the left-end Ad5 sequences including the packaging signal produce infectious viral vectors with an efficiency comparable to that obtained with pJM17.

Use of the pBHGE3, pBHG10, or pBHGl1 combined with the 3.2-kb deletion in E1 permits superantigen DNA inserts of ~5.2, −7.9, and −8.3. respectively, into viral vectors. To test the capacity of the BHG system, a 7.8 kb consisting of the lacZ gene driven by the HCM promoter (E1-antiparallel orientation) and the SEB gene driven by the beta actin promoter (E1-parallel orientation) are inserted into the 3.2-kb E1 deletion. The 7.8-kb insert is constructed by inserting the 4.1-kbXba I fragment from the SEB gene containing the SEB gene driven by the beta actin promoter into the Xba I site in pHCMVsplZacZ generating pH/acSEB. The isolate pH/acSEB expressed both lacZ and SEB at levels comparable to those obtained with vectors containing single inserts.

The Method: The first step involves the construction of AdBHG, a virus that contains the Ad5 genome with the deletion of E3 sequences from by 28,133 to 30,818 and the insertion of modified pBR322 at by 1339. AdBHG is made by cotransfection of 293 cells with purified viral DNA from Ad5 PacI, digested with Cia I and Xba I, and pWH3.

The next step involves the generation of a bacterial plasmid containing the entire AdBHG genome and subsequent identification of infectious clones. Baby rat kidney (BRK) cells are infected with AdBHG under conditions that result in the generation of circular Ad5 genomes. At 48 h after infection DNA is extracted from the infected BRK cells and used to transform *E. coli* HMS 174 to ampicillin and tetracycline resistance (Apr and Tetr, respectively). From two experiments, plasmid DNA from a total of 104 colonies is screened by Hindlll and BamHI/Sma I digestion and gel electrophoresis. Plasmids that appear to posses a complete AdBHG genome are selected and all four are found to be infectious when transfected into 293 cells.

The final step involves generation of pBHG 10 by deleting the packaging signals in pBHG9 by partial BamHI digestion and relegation. The left and right termini of the Ad5 genomes are covalently joined and a segment of plasmid pBR322 is present between AdS bp 188 and 1339 to allow propagation of pBHG10 in *E. coli*. A Pac I restriction enzyme site, unique in this plasmid, is present between AdS bp 28,133 and by 30,818 to permit insertion of the superantigen genes. Because the packaging signal is deleted, pBHG10 is noninfectious but cotransfections with plasmids that contain the left-end Ad5 sequences including the packaging signal produce infectious viral vectors with an efficiency comparable to that obtained with pJM17.

To generate two useful variants, pBHGE3 and pBHGl1 are constructed from the original plasmid pBHG10. pBHGE3 permits construction of vectors with wt E3 sequences and pBHGl 1 increase the cloning capacity of resulting viral vectors. The 2.69-kb E3 deletion in pBHGlO removes the major portions of all E3 mRNAs, the first E3 3' splice acceptor site, and the L4 polyadenylylation site but leaves the E3 promoter, the 5' initiation site, the first E3 5' splice donor site, and the E3b polyadenylylation site intact. Viruses with the 2.69-kb E3 deletion have the same growth kinetics and progeny virus yields as wt virus. The 3.1-kb E3 deletion in pBHG1 1 removes two additional elements not removed by the 2.69-kb E3 deletion: the first E3 5' splice donor site and the E3b polyadenylylation site. This deletion does not interfere with the open reading frame for pVIII or any of the L5 family of mRNAs. Viruses containing the 3.1-kb deletion give wt progeny yields in infected 293 cells. [01654] To maximize the capacity of the BHG system and to facilitate the introduction of inserts such as the SEB gene into the El region, plasmids containing a 3.2-kb deletion of El sequences and multiple restriction sites for the insertion of foreign genes have been constructed. This deletion leaves intact the left ITR and packaging signals and extends just past the Spi binding site of the protein IX promoter. The promoter for transcription of the protein IX gene is relatively simple, consisting of this Spi binding site and a TATA box. The Spi binding site is essential for expression of protein IX and it is therefore, reintroduced at a position 1 bp closer to the TATA box than in the wt promoter. However, neither the original 3.2-kb E1 deletion nor the deletion mutants containing the synthetic Spi site are significantly altered in protein IX expression, heat stability or final progeny yields of viruses with this deletion.

ADDITIONAL DOCUMENTS INCORPORATED BY REFERENCE

This application incorporates by reference the following patents and currently pending patent applications that disclose inventions of the present inventor alone or with co-inventors.

| Application Ser. No., Pat. No. or Publication No. | Title | Date of filing, issuance or publication |
|---|---|---|
| WO 91/10680 | Tumor Killing Effects of Enterotoxins and Related Cpds | published 25 Jul. 1991 |
| USSN 07/891,718 | Tumor Killing Effects of Enterotoxins and Related Cpds | filed 01 Jun. 1992. |
| U.S. Pat. No. 5,728,388 | Method of Cancer Treatment | issued Mar. 17, 1998. |
| USSN 08/491,746 | Method of Cancer Treatment | filed 19 Jun. 1995. |
| USSN 08/898,903 | Method of Cancer Treatment | filed 23 Jul. 1997. |
| USSN 08/896,933 | Tumor Killing Effects of Enterotoxins and Related Cpds | filed 18 Jul. 1997. |
| USSN 60/085,506 | Compositions and Methods for Treatment of Cancer | filed 05 May 1998. |
| USSN 60/094,952 | Compositions and Methods for Treatment of Cancer | filed 31 Jul. 1998. |
| USSN 60/033,172 | Superantigen-Based Meth and Compositions for Treatment of Cancer | filed 17 Dec. 1996. |
| USSN 60/044,074 | Superantigen-Based Meth and Compositions for Treatment of Cancer | filed 17 Apr. 1997. |
| USSN 09/061,334 | Tumor Cells with Increased Immunogenicity and Uses Thereof | filed 17 Apr. 1998. |
| USSN 09/311,581 | Compositions and Meth for Treating Neoplastic Disease | filed 14 May 1999. |
| USSN 60/173,371 | Compositions and Meth for Treating Neoplastic Disease, | filed 28 Dec. 1999 |
| USSN 05/208,128 | Compositions and Meth for Treating Neoplastic Disease | filed 31 May 2000 |
| USSN 09/650,884 | Compositions and Meth for Treating Neoplastic Disease | filed 28 Dec. 2000 |
| USSN 09/870,759 | Compositions and Meth for Treatment of Neoplastic Disease | filed 5 May 2001 |
| USSN 60/389,366 | Compositions and Meth for Treatment of Neoplastic Disease | filed 15 Jun. 2002 |
| USSN 60/406750 | Intrathecal Superantigens to Treat Malignant Fluid Accumulation | filed 29 Aug. 2002 |
| USSN 60/406,697 | Compositions and Meth for Treatment of Neoplastic Diseases | filed 28 Aug. 2002 |
| USSN. 60/378,988 | Compositions and Meth for Treatment of Neoplastic Diseases | Filed 8 May 2002 |
| USSN 09/751,708 | Compositions and Meth for Treatment of Neoplastic Diseases | Filed 28 Dec. 2000 |

Moreover, all references cited herein are incorporated by reference, whether specifically incorporated or not.

Having now fully described this invention, it will be appreciated by those skilled in the art that the same can be performed within a wide range of equivalent parameters, concentrations, and conditions without departing from the spirit and scope of the invention and without undue experimentation.

While this invention has been described in connection with specific embodiments thereof, it will be understood that it is capable of further modifications. This application is intended to cover any variations, uses, or adaptations of the invention following, in general, the principles of the invention and including such departures from the present disclosure as come within known or customary practice within the art to which the invention pertains and as may be applied to the essential features hereinbefore set forth as follows in the scope of the appended claims.

SEQUENCE LISTING (96 sequences)

SEQ ID NO: 1 - DNA, 279 bp, Homo sapiens
  CDS (1)..(279)
gtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactgg

SEQ ID NO: 2 - protein, 93 aa, Homo sapiens
VKPKAWLSRGPSPGPGRLLLVCHVSGFYPKPVWVKWMRGEQEQQGTQPGDILPNADETWYLRATLDVVAGEAAGLSCRVKHSSLEGQDIVLYW

SEQ ID NO: 3 - DNA, 1443 bp, Staphylococcus aureus
  CDS (262)..(1032)
ccaaaataatggcaagtactccgttgtcaataccaagtaagtaagatatctgaaatgtataatagagtaaaaatgaaatctttttattatattatagacaagtataaaaaaggtatagtaatatatgtatgtataagtaaataatgataattctataattattgtatataactaataattacttcgacaaaaataatctattatccaaatattttagataataaaaagtttgtatggaattatgctttagaggtgagcaaaatgaaaaaaacagcatttatactacttttattcattgccctaacgtggacaacaagtccacttgtaaatggtagcgagaaaagcgaagaaataaatgaaaaagatttgcgaaaaaagtctgaattgcagggagcagctttaggcaatcttaaacaaatctattattacaatgaaaaagctaaaactgaaaataaagagagtcacgatcaatttttacagcatactatattgtttaaaggcttttttacaaatcattcatggtataacgatttattagtagattttgattcaaaggatattgttgataaatataaagggaaaaaagtagacttatatggtgcttattatggttatcaatgtgcgggtggtacaccaaacaaaacagcttgcatgtatggtggtgtaacgttacatgataataatcgattgaccgaagagaaaaaagtgccgatcaatttatggctagacggtaaacaaaatacagtacctttggaaacggttaaaacgaataagaaaaatgtaactgttcaggagttggatcttcaagcaagacgttatttacaggaaaaatataatttatataactctgatgtttttgatgggaaggttcagaggggattaatcgtgtttcatacttctacagaaccttcggttaattacgatttatttggtgctcaaggacagaattcaaatacactattaagaatatatagagataataaaacgattaactctgaaaacatgcatattgatatatatttatatacaagttaaacatggtagttttgaacacgtaatgttcagattattatgaaccgagaataatctgaaagtttacaagcagtaaaaaaagtatatgtgctataatatgctttgagcaagttggatagatggtggctatctgagtataaggaggtggtgcctatggtggcattactgaaatctttagaaaggagacgcctaatgattacaattagtaccaatgttgcagtttggtttattccttattgcattgataggtctagtaatcaagcttattgaattaagcaataaaaaataaccatcgctaactttggctggtttcgatggttaaatggttattaatttaatctttaatctaaaatagccaccgtctttttaacgggctcattagggtaacatgtttgcgcatgttgccctttt

SEQ ID NO: 4 - protein, 257 aa, Staphylococcus aureus
MKKTAFILLLFIALTWTTSPLVNGSEKSEEINEKDLRKKSELQGAALGNLKQIYYYNEKAKTENKESHDQFLQHTILFKGFFTNHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQNSNTLLRIYRDNKTINSENMHIDIYLYTS

SEQ ID NO: 5 - DNA, 1712 bp, Staphylococcus aureus
  CDS (244)..(1044)
gaactaggtagaaaaataattatgagaaaacactatgttgttaaagatgttttcgtatataagtttaggtgatgtatagttacttaattttaaaagcataacttaattaatataaataacatgagattattaaatataattaagtttcttttaatgtttttttaattgaatatttaagattataacatatatttaaagtgtatctagatactttttgggaatgttggataaaggagataaaaaatgtataagagattatttatttcacatgtaattttgatattcgcactgatattagttatttctacacccaacgttttagcagagagtcaaccagatcctaaaccagatgagttgcacaaatcgagtaaattcactggtttgatggaaaatatgaaagttttgtatgatgataatcatgtatcagcaataaacgttaaatctatagatcaatttctatactttgacttaatatattctattaaggacactaagttagggaattatgataatgttcgagtcgaatttaaaaacaaagatttagctgataaatacaaagataaatacgtagatgtgtttggagctaattattattatcaatgttatttttctaaaaaaacgaatgatattaattcgcatcaaactgacaaacgaaaaacttgtatgtatggtggtgtaactgagcataatggaaaccaattagataaatatagaagtattactgttcgggtatttgaagatggtaaaaatttattatcttttgacgtacaaactaataagaaaaaggtgactgctcaagaattagattacctaactcgtcactatttggtgaaaaataaaaaactctatgaatttaacaactcgccttatgaaacgggatatattaaatttatagaaaatgagaatagcttttggtatgacatgatgcctgcaccaggagataaatttgaccaatctaaatatttaatgatgtacaatgacaataaaatggttgattctaaagatgtgaagattgaagtttatcttacgacaaagaaaaagtgaaattatattttagaaaagtaaatatgaagagttagtaattaaggcaggcacttatagagtacctgccttttctaatattatttagttatagttatttttgttatatctctctgatttagcattaaccccttgttgccattatagttttcaccaactttagctgaaattgggggatcatttttatctttactatggatagttactgtgtcgccgtttttaacgatttgtttctcttttaatttgtcagttaattttttccatgcatcatttgcgtcaaacctatttccatttggatttattcttgacaaatcaattcttttaacactatcggtattaatcggcttgttattaaaattactaagttcatctaaatcagctgtacccgtaatactactttcgccaccattatttaaattgtacgtaacaccaactgtctcatttgctgttttatcgataatatttgcttctttcaaagcatctcttacatttttccataagtctctatctgttatttcagaagcctttgcaacgttattaataccattataatttgaagaagaatgaaaacctgaacctactgttgttaaaactaaagcacttgctatcaatgttcttgttaatagttttttattcattttattttctcctataacttatttgcaatcgat

SEQ ID NO: 6 - protein, 266 aa, Staphylococcus aureus
MYKRLFISHVILIFALILVISTPNVLAESQPDPKPDELHKSSKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 7 - DNA, 1095 bp, Staphylococcus aureus
  CDS (118)..(918)
atcattaaatataattaattttcttttaatatttttttaattgaatatttaagattataagatatatttaaagtgtatctagatactttttgggaatgttggatgaaggagataaaaatgaataagagtcgatttatttcatgcgtaattttgatattcgcacttatactagttctttttacacccaacgtattagcagagagccaaccagaccctacgccagatgagttgcacaaagcgagtaaattcactggtttgatggaaaatatgaaagttttatatgatgatcattatgtatcagcaactaaagttaagtctgtagataaatttttggcacatgatttaatttataacattagtgataaaaaactgaaaaattatgacaaagtgaaaacagagttattaaatgaaggtttagcaaagaagtacaaagatgaagtagttgatgtgtatggatcaaattactatgtaaactgctatttttcatccaaagataatgtaggtaaagttacaggtggcaaaacttgtatgtatggaggaataacaaaacatgaaggaaaccactttgataatgggaacttacaaaatgtacttataagagtttatgaaaataaaagaaacacaatttcttttgaagtgcaaactgataagaaaagtgtaacagctcaagaactagacataaaagctaggaattttttaattaataaaaaaaatttgtatgagtttaacagttcaccatatgaaacaggatatataaaatttattgaaaataacggcaatactttttggtatgatatgatgcctgcaccaggcgataagtttgaccaatctaaatatttaatgatgtacaacgacaataaaacggttgattctaaaagtgtgaagatagaagtccaccttacaacaaagaatggataatgttaatccgattttgatataaaaagtgaaagtattagatatatttgaaaggtaagtacttcggtgcttgcctttttaggatgcatatatatagattaaaccgcacttctatattaatagaaagtgcggttatttatacactcaatctaaactataataattggaatcatcttcaaa

SEQ ID NO: 8 - protein, 266 aa, Staphylococcus aureus
MNKSRFISCVILIFALILVLFTPNVLAESQPDPTPDELHKASKFTGLMENMKVLYDDHYVSATKVKSVDKFLAHDLIYNISDKKLKNYDKVKTELLNEGLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 9 - DNA, 1136 bp, Staphylococcus aureus
  CDS (292)..(1068)
gatcaaatatattgatataatgaaagtgagcaagttggatagattgcggctagtctcttgaaaaaagggattcctatgtttatagttggtacttctaggaaggactagcatgtcttatttcgaaatgctgatggttgtattaacaattatgagtttagtcttaattagtaatcaaaactctgaatgtattgtctacataatcggtgtaacaataatatatatccgaaagattaaagtactctataaaagaatcatttaaaggtgctcaaatttattgaaaaaaggtggaatatgaaaaaatttaacattcttattgcattactcttttttactagtttggtaatatctcctttaaacgttaaagccaatgaaaacattgattcagtaaaagagaaagaattgcataaaaaatctgaattaagtagtaccgcgctaaataatatgaaacattcttatgcagataaaaatccaataataggagaaaataaaagtacaggagatcaatttttagaaaatactttgctttacaaaaaattttttactgaccttatcaattttgaagatttattaataaacttcaattcaaaagaaatggctcaacatttcaaatctaaaaatgtagatgtttaccctataagatatagcattaattgttatggtggtgaaatagataggactgcttgtacatatggaggtgtcactccacacgaaggtaataaattaaaagaacgaaaaaaaataccaatcaatttgtggataaatggtgtacaaaaagaagtttctttagataaagttcaaacagataaaaaaaatgttaccgtacaagaattagatgcacaagcaaggcgctatttgcaaaaggatttaaaattgtataataatgatactctcggaggaaaaatacagcgcggaaaaatagagtttgattcttctgatgggtctaaagtctcttatgatttatttgatgttaagggtgattttcccgaaaaacaattacgaatatacagtgataataaaacattatccacagagcaccttcatattgacatctatttatatgaaaagtagtcaattcaaatactttaacatcagacactaaagccatttcaaagaatgctaaagatttattaatcggt

SEQ ID NO: 10 - protein, 258 aa, Staphylococcus aureus
MKKFNILIALLFFTSLVISPLNVKANENIDSVKEKELHKKSELSSTALNNMKHSYADKNPIIGENKSTGDQFLENTLLYKKFFTDLINFEDLLINFNSKEMAQHFKSKNVDVYPIRYSINCYGGEIDRTACTYGGVTPHEGNKLKERKKIPINLWINGVQKEVSLDKVQTDKKNVTVQELDAQARRYLQKDLKLYNNDTLGGKIQRGKIEFDSSDGSKVSYDLFDVKGDFPEKQLRIYSDNKTLSTEHLHIDIYLYEK

SEQ ID NO: 11 - DNA, 774 bp, Staphylococcus aureus
  CDS (1)..(744)
atgaaaaaaacagcatttatactacttttattcattgccctaacgttgacaacaagtccacttgtaaatggtagcgagaaaagcgaagaaataaatgaaaaagatttgcgaaaaaagtctgaattacaaagaaatgctttaagcaatcttaggcaaatttattattataatgaaaaagctataactgaaaacaaagagagtgatgatcagtttttagagaatactttgttatttaaaggttttttcacaggtcatccatggtataacgatttattagtagatcttggttcaaaagatgctactaataaatataaagggaaaaaagtagacttatatggtgcttattatggatatcaatgtgctggaggcacaccaaataaaacagcatgtatgtacgggggtgtaacattacatgataataaccgattgaccgaagaaaaaaaagtaccaattaacttgtggatagacggaaaacaaactacagtacctatagataaagttaaaacaagcaaaaaagaagtaactgttcaagagctagatcttcaggcaaggcattatttacacggaaaatttggtttatataactcagacagctttggcggtaaggtgcaaagaggcttgattgtgtttcattcttctgaagggtccacggtaagttatgatttgtttgatgctcaagggcaatatccagatacattattaagaatttacagagataataaaactattaattcagagaacctccatattgatttgtatttatacacaacttga

SEQ ID NO: 12 - protein, 248 aa, Staphylococcus aureus
MKKTAFILLLFIALTLTTSPLVNGSEKSEEINEKDLRKKSELQRNALSNLRQIYYYNEKAITENKESDDQFLENTLLFKGFFTGHPWYNDLLVDLGSKDATNKYKGKKVDLYGAYYGYQCAGGTPNKTACMYGGVTLHDNNRLTEEKKVPINLWIDGKQTTVPIDKVKTSKKEVTVQELDLQARHYLHGKFGLYNSDSFGGKVQRGLIVFHSSEGSTVSYDLFDAQGQYPDTLLRIYRDNKTINSENL

SEQ ID NO: 13 - DNA, 1873 bp, Mus musculus
  CDS (173)..(175)
  CDS (273)..(314)
  CDS (315)..(1367)
aggaagggacagggtgacaccccaggattacataaatttacaggggctgccgaattggtcgaacaagcccgtggaacctggaagccagagaacaccatcgctgtaaaggaaagaaactgaagcttttctcggagcctatctgggctgctcaaactttcagaatctaccgaccatggtgagtcagacagactgtcttggggtggaactggagccaacctgaggaatctcagggtcctggcaggagtctccctgtccccctactttctcctcaggagcgtgtgcttggcttgttgctgttgcttctggtgcacgcctctcccgccccaccagagccctgcgagctagacgaggaaagttgctcctgcaacttctcagatccgaagccagattggtccagcgctttcaattgtttgggggcggcagatgtggaattgtacggcggcggccgcagcctggaataccttctaaagcgtgtggacacggaagcagatctggggcagttcactgatattatcaagtctctgtccttaaagcggcttacggtgcgggccgcgcggattcctagtcggattctattcggagccctgcgtgtgctcgggatttccggcctccaggaactgactcttgaaaatctcgaggtaaccggcaccgcgccgccaccgcttctggaagccaccggacccgatctcaacatcttgaacctccgcaacgtgtcgtgggcaacaagggatgcctggctcgcagaactgcagcagtggctaaagcctggactcaaggtactgagtattgcccaagcacactcactcaacttttcctgcgaacaggtccgcgtcttccctgccctctccaccttagacctgtctgacaatcctgaattgggcgagagaggactgatctcagccctctgtcccctcaagttcccgaccctccaagttttagcgctgcgtaacgcggggatggagacgcccagcggcgtgtgctctgcgctggccgcagcaagggtacagctgcaaggactagaccttagtcacaattcactgcgggatgctgcaggcgctccgagttgtgactggcccagtcagctaaactcgctcaatctgtctttcactgggctgaagcaggtacctaaagggctgccagccaagctcagcgtgctggatctcagttacaacaggctggataggaaccctagcccagatgagctgccccaagtggggaacctgtcacttaaaggaaatccctttttggactctgaatcccactcggagaagtttaactctggcgtagtcaccgccggagctccatcatcccaagcagtggccttgtcaggaactctggctttgctcctaggagatcgcctctttgtttaaggaacatttgcatcctcctggtttctgagggtcctcgtcaacgaatcctctgctttaaatttattaaaatcttaatccacgatgtaaggaaagaaaggcagtcaagatggttcagtgggtaaaagccagcaaacttgacccctgattttaaccctcaggatccacacggaaggggaaaactcactcctgaaagttgtccatctgtgctcacaaataaatattttttaaaataacaatgtgtttgttggttttgtttttgtttgggttttgttgtggttttgtttgttttgttttgtttttgagacagtctggctatgtatccttggctggcctcaaactcataaagatcaagatcggcctgcctctacctccaaatgctctggttaaagggatgtgcctccatgcccagttgaagtcatcctgaaccacgagtccaggccactcactctttactaagatctttactaagtatctgccataggtcaggctcagtgctaaatgag

SEQ ID NO: 14 - protein, 366 aa, Mus musculus
MERVLGLLLLLLVHASPAPPEPCELDEESCSCNFSDPKPDWSSAFNCLGAADVELYGGGRSLEYLLKRVDTEADLGQFTDIIKSLSLKRLTVRAARIPSRILFGALRVLGISGLQELTLENLEVTGTAPPPLLEATGPDLNILNLRNVSWATRDAWLAELQQWLKPGLKVLSIAQAHSLNFSCEQVRVFPALSTLDLSDNPELGERGLISALCPLKFPTLQVLALRNAGMETPSGVCSALAAARVQLQGLDLSHNSLRDAAGAPSCDWPSQLNSLNLSFTGLKQVPKGLPAKLSVLDLSYNRLDRNPSPDELPQVGNLSLKGNPFLDSESHSEKFNSGVVTAGAPSSQAVALSGTLALLLGDRLFV

SEQ ID NO: 15 - protein, 365 aa, Mus musculus
MDKFWWHTAWGLCLLQLSLAHPHQQIDLNVTCRYAGVFHVEKNGRYSISRTEAADLCQAFNSTLPTMDQMKLALSKGFETCRYGFIEGNVVIPRIHPNAICAANHTGVYILVTSNTSHYDTYCFNASAPPEEDCTSVTDLPNSFDGPVTITIVNRDGTRYSKKGEYRTHQEDIDASNIIDDDVSSGSTIEKSTPESYILHTYLPTEQPTGDQDDSFFIRSTLATRDRDSSKDSRGSSRTVTHGSELAGHSSANQDSGVTTTSGPMRRPQIPEWLIILASLLALALILAVCIAVNSRRRCGQKKKLVINGGNGTVEDRKPSELNGEASKSQEMVHLVNKEPSETPDQCMTADETRNLQSVDMKIGV

SEQ ID NO: 16 - protein, 371 aa, Mus musculus
MNVKGKVILLMLIVSTVVVVFWEYVNSPDGSFLWIYHTKIPEVGENRWQKDWWFPSWFKNGTHSYQEDNVEGRREKGRNGDRIEEPQLWDWFNPKNRPDVLTVTPWKAPIVWEGTYDTALLEKYYATQKLTVGLTVFAVGKYIEHYLEDFLESADMYFMVGHRVIFYVMIDDTSRMPVVHLNPLHSLQVFEIRSEKRWQDISMMRMKTIGEHILAHIQHEVDFLFCMDVDQVFQDNFGVETLGQLVAQLQAWWYKASPEKFTYERRELSAAYIPFGEGDFYYHAAIFGGTPTHILNLTRECFKGILQDKKHDIEAQWHDESHLNKYFLFNKPTKILSPEYCWDYQIGLPSDIKSVKVAWQTKEYNLVRNNV

SEQ ID NO: 17 - DNA, 79 bp, Homo sapiens
  CDS (3)..(77)
gcagtttaacgggggaggggactcagccccagcattttggtgatgggactcgactctccatcctagaggacctgaacaa

SEQ ID NO: 18 - protein, 25 aa, Homo sapiens
SLTGEGTQPQHFGDGTRLSILEDLN

SEQ ID NO: 19 - DNA, 1197 bp, Streptococcus pyogenes
  CDS (106)..(1119)
attggctctggagatggattataaagagattgcagatgccaaaggtgcaactatcacaggggcatggtcagacagtccacaaattatattagacggaggtaaaaaatgagtgaaaatataccgctgcgagtccaatttaagcgcatgaaagccgccgagtgggctcgtagtgatgtcatcttactggagagcgagataggctttgagacagacacaggttttgccagagcaggtgatgggcacaatcgatttagtgaccttggatacattagtccactcgattacaatctactgactaacaagccaaatattgatggattagcgacaaaagtcgagaccgctcagaaactacaacaaaaagcagataaagagaccgtctatacaaaagctgaatcgaagcaagagcttgacaagaaattaaatctcaaaggtggcgttatgacaggtcaactaaaatttaagccagccgccactgttgcttattcctcgtcaacgggtggagcggtcaatattgacttgtcgtctaccagaggtgctggtgttgttgtctattctgacaatgataccagtgatgggccgttaatgagcttgcggacgggtaaagagacctttaatcaatcggcgctttttgtcgactataaggggacaacaaatgccgttaatattgcgatgcgtcacgcaaccacccccaatttttcatcggcgcttaatattactagcggcaatgaaaatggtagtgcaatgcagctacgagggtcagaaaaagcgctaggaacgctaaaaattactcatgagaacccaagtattggagcggattatgataaaaatgcggcacgttatccattgatattgtcaaaaagacaaaacggtgcaggaacagccgctcagggaatctacattaactcaacctcaggcacgacagggaagttgcttaggattagaaaccttagtgatgataagttctacgtcaagtctgacggtggtttttatgccaaggaaacttcgcagattgatggcaacctgaaactcaaggaccccacagcgaatgatcatgcggcaaccaaagcttatgtagataaagcaatttctgagttaaaaaaactcatactaaaaaaatagattaaggaggataaatgagcagagacccaacacttattttagacgagtcaaacctcgttattggtaaggatggacgtg

SEQ ID NO: 20 - protein, 337 aa, Streptococcus pyogenes
MSENIPLRVQFKRMKAAEWARSDVILLESEIGFETDTGFARAGDGHNRFSDLGYISPLDYNLLTNKPNIDGLATKVETAQKLQQKADKETVYTKAESKQELDKKLNLKGGVMTGQLKFKPAATVAYSSSTGGAVNIDLSSTRGAGVVVYSDNDTSDGPLMSLRTGKETFNQSALFVDYKGTTNAVNIAMRHATTPNFSSALNITSGNENGSAMQLRGSEKALGTLKITHENPSIGADYDKNAARYPLILSKRQNGAGTAAQGIYINSTSGTTGKLLRIRNLSDDKFYVKSDGGFYAKETSQIDGNLKLKDPTANDHAATKAYVDKAISELKKLILKK

SEQ ID NO: 21 - DNA, 1497 bp, Bacteriophage T270
  CDS (286)..(1374)
gaagacattgtaaaatacaatacaattatgagagatcaatataaaaaaggtagcaatgaatataatgcgtttcaacaagatattgagcaagataaaaaccagatagcactattgttcaacgaacatcaattgcttgaaaatatcgataattagttaatctaaaacaaaaagccccacgctctcaaagtttggcgactctgagcgtgaggcaagacagtataagaaacaaccattaaaaaggtcattttcttgtacctattttatcaaattgaaagatggtatgcaatgaaaattaaatcatataaaaaggaaaatggtgaaactgcttataaatttcttttgtatgccggttatgttaatggaaagagaaaatatattaggcgagaaggtttcaaaactaagcaggctgcaagggaaaccttaattagtttacaagctgaacttgataaacctaaatcaagtatgacatttggagcattgacagatcaatggctaaaggaatatgaaaaaaccgttcagggcagtacctacttaaaaacagaaagaaatattaataaacatattttgccaaaacttgataaagtgaagattggagacatcaatccactacttatccagcggcttactgaagaatggtgcaacgatttaaaatatggaggaaaaattcttgggcttgttaggaatatcttaaatctagctgttagatacggatatatcaataacaatccagctttgccaattacacctccaaaaataaaaaggaaaagaaaaatgaataataatttttatacacttgatcaacttaaacaattccttgaactagttgaaaaaactgacaacattgaaaaaatagccttgtttagattattagcatttactggaatacgaaaaggggagcttctggcactaacttgggatgatttgaatggtaatactctatcaattaataaagctgtcacacgtactcaagttggactagaaatagatgttacgaagacaaaatcaagcgatagattaatcagcttagatgatgaaactttggaaattttacaagaacttcatgaaacttttcctacttctactcttatgttccaatctaaatcaggtggaattatgacgccaagtttaccacgaaaatggctattgcaaattatcaaagggatagacttaccacaaatcacaattcatggtttcaggcacactcatgcaagcttacttttcgaatcaggtctatccttgaaacaggtgcaacatagattagggcatggagatttacagacaactatgaacgtatatactcacatcacgcaatcggcaattgatgacattggaactaaattcaatcaatttgttactaacaagcaactagattgacaactaattctcaacaaacgttaatttaacaacattcaagtaactcccaccagctccatcaatgcttaccgtaagtaatcataacttactaaaaccttgttacatcaaggttttttctttttg

SEQ ID NO: 22 - protein, 362 aa, Bacteriophage T270
MKIKSYKKENGETAYKFLLYAGYVNGKRKYIRREGFKTKQAARETLISLQAELDKPKSSMTFGALTDQWLKEYEKTVQGSTYLKTERNINKHILPKLDKVKIGDINPLLIQRLTEEWCNDLKYGGKILGLVRNILNLAVRYGYINNNPALPITPPKIKRKRKMNNNFYTLDQLKQFLELVEKTDNIEKIALFRLLAFTGIRKGELLALTWDDLNGNTLSINKAVTRTQVGLEIDVTKTKSSDRLISLDDETLEILQELHETFPTSTLMFQSKSGGIMTPSLPRKWLLQIIKGIDLPQITIHGFRHTHASLLFESGLSLKQVQHRLGHGDLQTTMNVYTHITQSAIDDIGTKFNQFVTNKQLD

SEQ ID NO: 23 - DNA, 2187 bp, Staphylococcus aureus
  CDS (752)..(1744)
atcgataactttctttgttccatttttaaagtaaacagtatatttcgcttgcttcgatagtcttaaatctatatcactaatacctctgtctgattttaaaactgatttaactctatcctctaaatctttataactaatattttgattcttattaaatgttaagcttgataaaatattttggcttgtaccgttcacagtgattgcatatggaacatggactttagaatatccatggtgtaacgaacttgatgatttatctaatggcttagctgcggcagacgcttcattattattaaagtttgcacctgttgatgctaaaacacctaatgctaaagttgttgtaatcaatgacttaaatttcataaattatctctccttttttgtgtaattcgtatttgcaacttaattatagccagactttctctattttttgaattaactgaatattaataataaattatctttaacaataattttttaacactgttaaaagttcttttaattttgattaactaattaatttacaatacctaaaatgttgtttggttttgtttataccaagcttcaaacttaaatgtcataacaacattcatttcttaattccgattagatttgtcgattatatttacagcatctttatactcaaaaaacatttacttaaaaatataaattctatttaataattaatttaaatttagttaatcaattttgcatctattttgttgtaagctatataaaaggagtgataatgatggtgaaaaaaacaaaatccaattcactaaaaaaagttgcaacacttgcattagcaaatttattattagttggtgcacttactgacaatagtgccaaagccgaatctaagaaagatgatactgatttgaagttagttagtcataacgtttatatgttatcgaccgttttgtatccaaactgggggcaatataaacgcgctgatttaatcggacaatcttcttatattaaaaataatgatgtcgtaatattcaatgaagcatttgataatggtgcatcagacaaattattaagtaatgtgaaaaaagaatatccttatcaaacacctgtactcggccgttctcaatcagggtgggacaaaactgaaggtagctactcatcaactgttgcagaagatggtggcgtagcgattgtaagtaaatatcctattaaagaaaaaatccagcatgttttcaaaagcggttgtggattcgataatgatagcaacaaaggctttgtttatacaaaaatagagaaaaatggtaagaacgttcacgttatcggtacacatacacaatctgaagattcacgttgtggtgctggacatgatcgaaaaattagagctgaacaaatgaaagaaatcagtgactttgttaaaaagaaaaatatccctaaagatgaaacggtatatataggtggcgaccttaatgtcaataaaggcactccagagttcaaagatatgcttaaaaacttgaatgtaaatgatgttctatatgcaggtcataatagcacatgggaccctcaatcaaattcaattgcgaaatataattaccctaatggtaaaccagaacatttagactatatatttacagataaagatcataaacaaccaaaacaattagtcaatgaagttgtgactgaaaaacctaagccatgggatgtatatgcgttcccatattactacgtttacaatgatttttcagatcattacccaatcaaagcctatagtaaatagtgctcaactaactaataactttgcttcgttctaaaaggacgaagcgagttatattgttaaaatttgaattgacttacattttaataaaatcatcttaacaactttaatttttcattaatacaagtctttactctacactcaaacaagattcatacactgcacgtcataataaatctatctattcaaatataaataaaagttacctactacattctatgtagcaggcaacttttattacttatttcttttcattatcattaagtacttttacaaacttcacattatgtgtcttccaatcaacttcatataatgctgataatttttcttcttttttatctacatggttttcaccagaccaatagccccagaaaccatggcgattccaatctattttaaactcatccattgatcgtttaactctaacgtgtcgcatggaaatcgat

SEQ ID NO: 24 - protein, 330 aa, Staphylococcus aureus
MVKKTKSNSLKKVATLALANLLLVGALTDNSAKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 25 - DNA, 17276 bp, Streptococcus agalactiae
  CDS (7062)..(8207)
acaatctcaggactgtttatttttatgattaaacgaaacttcctctaataaatagtcaataaatttttgtcccatttttgaaaggtttgctttgtcgtgtcggatatagacaatatcaataacatcatccacgtcaagagggattgcgacaatttcgtcaccgttcaattttgagttgaggataccagttgccactgtataaccatctaatccaatcattaaattaaacagagttgctctatcactgacaacaatggattttgggtgaggaatttgagacatcatttcctcagaaaagtagaaagaattatgcaggccttgatcataactcagataaggataatcttctaaatctttcatacttaatttttttctattagctaagggattggatttgctcacgaaaatatgaggtgtagtagtaaaaagagttgtggcaattaaggaattatcgtcgaataatttggttaatacatctctattatagctattaagaaacagaacaccaatctctgaacggaaatttttaacatcatcaataatttcccaagtcctagtttcacgtaaaaaaagttcgtattgggtcatgtctgtgccattaaagagagctacaaaagcgttaaccacaaatgcatagtgttgtgaagaaacgctgaacagctcacgacttgtattatcacccttataacgctcttcaagaagtgctgtttgttctagaatttgtcgcgcatatgacagaaattccataccatcttttgttaacgttattccttttggatttcgaataaaaatttggatacccatctcagtctcaaggttcctaacagcgtttgaaagtgaaggttgggtaatgtagagttgtttagcggcttcattcatgctaccagtttctacaatcttaataacatattgtaattgttgaattctcataattctagtttaaactagaatgtaaataaattcaattagatcagctaaattatcaatatagatcaattgaaaatgttatttagctaatataatcagattattccaatattattttcgttgaatattgtattgaaaaatgatataatatccaagtaaaattaaggtttttttaagtattggagaattacaatgtctaatcattcgcgccgtcaccaaaagaaacactcacatacacctctacgggtgattaatttatttcttttggtgatttttattttgttaagtgtagtctcattatttcttatgtatcgtcaccattttttggcatttagacacttgaacgtcatttatggagttgtaattattttaatcattttagcaagtttatttctttgtattaagaataaagctagaatttttacaactataattttagtactatcctctattttcgttgctactactttatatggatttaagtcaaccattgatttgacaaataatctaaataaaactgcttcatactctgaaattgagatgagtgtagttgtaccaaaagattctaaaataaccaatatagaagctgtcagcaaattagccgcaccagttaaaaacgatacttcaaatattactgatttgatagaacatataaaatcagaaaaaggaatctctattacaccacaaaaaacagattcttaccaggatgcatacaatagaattaaaaatggtgatagtcaagctatggttttaaataatgcttatgttagcttaattgaacttagtacccctgattttaaatcgcagataaaaacgatttatacttacaaaattaagaaaaaaattaatcgtaaaaatactaatcataaagaaggggtatttaatatctatattagcggtattgatacttttggctctatatcaacagtatcaagatctgatgtaaatattattatgacggttaataccaatacccacaaagtattgttaacgacaacaccacgagatgcctatgtaaaaattccagatggtgggggcaatcaatatgataaattaacccatgcaggtttgtatggtgttgagacatcaatgaaaacacttgaaaacctttacgacatcaaccttgattattatgctagaattaatttttcatcattttttaaaattaatagacctcttgggaggagtgacagtttatatacgatcaagcttttacaagtaaacatggtaattttggactttcctgttggtcaagtaacattgaattctgagcaggctttgggctttgttagagaacgttattctctacaaggaggcgataacgatagaggtagaaatcaagaaaaagtgattgcagctattataaataagttagcttctagtcagtcagtaacaaaattaaatagcattacctcacagctccaaacgtccgttcaaactaatatgactattgataatattaatgatttgattaacaatcaattgtcaactggacaacgcttcactgtcgagtcacaagcattaactggtcatggttcaacgggtgaactcccttcatatgcaatgccaggagctcaactttatatgatgtcaattgatcaatctagcttatctaatgcaaaatcaaaaattaagaacacaatggaggaataacaagaatgattgatattcattctcatatcgtttttgatgtagatgatgggcccaaaacgcttgaagagagtttatctttaatagaagaaagttatcgacaaggtgttagaataattgtttcgacatcacatagaagaaaaggtatgtttgaaacacctgaagatattatcttcaaaaacttttctatagttaaacacgaaacggaaaaaagatttgaacatcttcaaatcttatatggtggagaattatactatacaagtgatatgttagaaaaactgaagttaaagcaaattccaactttaaacaatacgaaatttgctttaattgaattttctatgcaaacttcttggaaagatattcatacagctttgtcaaatgttttaatgcttggtattacaccagtcgttgcgcatatagagaggtataacgctttagagaatcaaaaagaacgggtgaaggaaattattaatatggggtgttacacacaaataaatagtttccatattttgaaacaaaaactttttaatgataagcataaacgctttaagaaaagagcccgttattttttagaggaaaatttagtgcattttgtagcgagtgatatgcataaccttgatgttagaccgccatttttagcagaagcttataagattatctgtagagatttcggtaaagaacgtgctaaccaactttttattgaaaatgctcaatctatattaaaaaaccattacatttaggagatttcatgaataaaatagctaatacagaagttgaaataaatatattcaaccttttaaaaaaattgtggaaaaagaaatttttaatcacatttgttgccattgcgtttgcaacagctggacttttctatagtctttttattgttacgccacaatatacttcttcaacaaggatatatgtcattaaccctaatacccctaataatagtattactgcacaagatctacaagcggggagttttcttgcaaatgactataaggagattattacgtctactgacgttctagaaaaagttatttcttctgaaaaattgaattatccttcgtctcagttgctacaaaaaataacagtttctattttaaaagatacacgtgttatttcaatatcggtcgaagatgctaatccaaaaatgtctcaaaaattagcaaattcagttagagaagcagcagtttcaaaaatcaaggcagttactcaagtagaggatatcactactcttgagaagggaaatttacctaaagcaccatcttctcctaatattaaaaagaatgtactaatcgggtttattgttggtgcaggattatcaactattgttttagttattatggggattttggatgatcgtgttaatactgaagaagatattgaaaaggtcttaggacttacttctttaggtatagtaccagatttgaataaactttaaggagaatataatgactcgtttagaaatagttgatagcaagttaagacaagcaaaaaaaacagaagaatacttcaatgcgatccgtacaaacatacagtttagtggaaaggaaaataaaattcttgcaattgcctctgttagggaaggggaaggaaaatccactacttcaacaagtttagctttatctttagctcaagcaggatttaaaacattattaattgatgcggatactaggaactctgttatgtctggaacctttaaagcaactggaactattaaaggcttgacgaattatttatcaggtaatgcagatcttggagatattatctgtgaaaccaatgttcctagactgatggtcgttccttcaggaaaagtaccaccaaatccaacagcattacttcagaacgcttattttaataagatgattgaagctattaaaaatatatttgattatattatcatcgatactccacctattggtttagttgttgatgccgcaataatcgctaatgcttgcgatggttttattttagtaacccaagcaggcagaataaaacgtaattatgttgaaaaagcaaaagaacagatggaacaaagtggttcaaagttcttaggtattattcttaataaagttaatgaatctgttgctacttacggcgattatggaaattacggaaaaagggatagaaaaaggaagtaagggactctggtattgaaagaaaaagaaaatatacaaaagattattatagcgatgattcaaacagttgtagtttatttttctgcaagtttgacattaacattaattactcccaattttaaaagcaataaagatttattgtttgttctattgatacattatattgttttttatctttctgatttttacagagacttttggagtcgtggctatcttgaagagtttaaaatggtattgaaatacagcttttactatattttcatatcaagttcattattttttatttttaaaaactcttttacaacgacacgactttccttttttacttttattgctatgaattcgattttattatatctattgaattcatttttaaaatattatcgaaaatattcttacgctaagttttcacgagataccaaagttgttttgataacgaataaggattctttatcaaaaatgacctttaggaataaatacgaccataattatatcgctgtctgtatcttggactcctctgaaaaggattgttatgatttgaaacataactcgttaaggataataaacaaagatgctcttacttcagagttaacctgcttaactgttgatcaagcttttattaacatacccattgaattatttggtaaataccaaatacaagatattattaatgacattgaagcaatgggagtgattgtcaatgttaatgtagaggcacttagctttgataatataggagaaaagcgaatccaaacttttgaaggatatagtgttattacatattctatgaaattctataaatatagtcaccttatagcaaaacgatttttggatatcacgggtgctattataggtttgctcatatgtggcattgtggcaatttttctagttccgcaaatcagaaaagatggtggaccggctatcttttctcaaaatagagtaggtcgtaatggtaggatttttagattctataaattcagatcaatgcgagtagatgcagaacaaattaagaaagatttattagttcacaatcaaatgacagggctaatgtttaagttagaagatgatcctagaattactaaaataggaaaatttattcgaaaaacaagcatagatgagttgcctcaattctataatgttttaaaaggcgatatgagtttagcaggaacacgccctcccacagttgatgaatatgaaaagtataattcaacgcagaagcgacgccttagttttaagccaggaatcactggtttgtggcaaatatctggtagaaataatattactgattttgatgaaatcgtaaagttagatgttcaatatatcaatgaatggtctatttggtcagatattaagattattctcctaacactaaaggtagttttactcgggacaggagctaagtaaaggtaaggtttgaaaggaatataatgaaaatttgtctggttggttcaagtggtggtcatctagcacacttgaaccttttgaaacccatttgggaaaaagaagataggttttgggtaacctttgataaagaagatgctaggagtattctaagagaagagattgtatatcattgcttctttccaacaaaccgtaatgtcaaaaacttggtaaaaaatactattctagcttttaaggtccttagaaaagaaagaccagatgttatcatatcatctggtgccgctgtagcagtaccattcttttatattggtaagttatttggttgtaagaccgtttatatagaggttttcgacaggatagataaaccaactttgacaggaaaattagtgtatcctgtaacagataaatttattgttcagtgggaagaaatgaaaaaagtttatcctaaggcaattaatttaggaggaattttttaatgatttttgtcacagtggggacacatgaacagcagttcaaccgtcttattaaagaagttgatagattaaaagggacaggtgctattgatcaagaagtgttcattcaaacgggttactcagacttcgaacctcagaattgtcagtggtcaaaatttctctcatatgatgatatgaactcttacatgaaagaagctgagattgttatcacacatggcggcccagcgacgtttatgtcagttatttctttagggaaattaccagttgttgttcctaggagaaagcagtttggtgaacatatcaatgatcatcaaatacaatttttaaaaaaaattgcccacctgtatcccttggcttggattgaagatgtagatggacttgcggaagcgttgaaaaggaatatagctacagaaaaatatcagggaaataatgatatgttttgtcataaattagaaaaaattataggtgaaatatgaggaaatatctagatttagattattctttattttatgctctttgggtacttattttagtaccaaaccaatggtatcagtttttaattattaccattatagttctattattactttggaagagtgagtttagaatatctataagcaattcttcaatactatttctgctttggttatttatttatttatttgcaatactcattagaggtactcaagaggatataacgtttcagcgatttattgctgagctattaaaactaattagtacaggatatgctttatttttttataattattatagaaaagctgattttaatagttcagttgtaaggaatgtggtaaaggttaactattttgtgttgtttcttataacagttttatatttattttttcctatgctgaagccaactttatttggaagagaattgttttcaatagagtggtttccacatatgagaataagacttgcggcatattttgaatatgctacactaattggtcagtttattttattttcttatcccatactttttttgaaaccccaaaaacatatggaaaatattttaatatccttactgttgactatatgttcatacttttctggcgctagaatactattggtctgtatgttggttttattagcatcgcttcttttagattatatcctttttaaaactaatttgaaattgaccaagaaaaacacttttatacttggtatgactttcttatttatcaccgcttgtttttcttataacatatggtcaataattgaaaaaataattatgtacagaaaccaaagtactatcactaggatgatagtttatcaagaaagtattattgaagttctaaaaggaaatattttatttggacagggtataaggattccatcaagtgaaggaatattcctaggatcgcattctacttatattagtgtcttttacaggacttctttattaggaattgttctttatttttctgcctttatacttttatataaagaagcgatttcaaaaaattataaaatctacagattatttttttatacgttattatgttacacgctctttgaggaaatagatcctaatcattggagtattgtattattattctcaacttttggtatagtgggaagggctaaaaaatgaaagaaaaagtaacagtcattatacctatatacaactcagaagcataccttaaagaatgtgtgcaatccgtactacaacagactcatccattgatagaagttatactaattgatgatggatccactgataatagtggagaaatttgtgataatttatctcaggaagataatcgcatacttgtatttcataaaaaaaatggaggggtctcttcggcaaggaacctaggtctagataaatccacaggagaattcataacatttgtggatagtgatgattttgtagcaccgaatatgattgaaataatgttaaaaaatttaatcactgagaatgctgatatagcagaagtagattttgatatttcgaatgagagagattatagaaagaagaaaagacgaaacttttataaagtttttaagaataataactctttgaaagaatttttatcaggtaatagagtggaaaatattgtttgtacaaaattatataaaaaaagtataattggtaacttgaggtttgatgagaacttaaaaattggtgaggatttactttttaattgcaaactcttatgtcaagagcaccgtatagtcgtagatacgacttcttccttatatacttatcgaattgtaaaaacttctgtaatgaatcagaaattcaacgaaaactcattagattttataacaatttttaatgaaataagtagtttggttcctgccagattagctaattatgttgaagcgaaatttttaagagaaaagataaagtgtctccgaaaaatgtttgaattaggtagtaatattgacaataaaatcaaagtacaacgagagatttttttcaaagacattaaatcatacccgttctataaagcggtcaaatacttatcattaaagggattattaagcttttatttaatgaaatgttcacctaaactatatgttatggcatatagaagatttcaaaaacagtagctggagaaatttggaaagagaatttataacttcatgataaagaaaattgaaaaggatttaataagtgtaattgtacctatttataatgttgaagattatttagttgaatgtatagaaagccttattgttcaaacatatcgaaatattgaaatattattgattaatgatggttcgacggataattgtgcaacaattgccaaagaattttctgaaagagattgtagagttatctatatagaaaagtcgaatggtgggttgtcagaagctagaaactatggaatttatcattcaaagggaaaatacttaacttttgttgattcagatgataaagtttcctctgattacatagcgaatttgtataatgctattcaaaaacatgattcgtctatagctatcggtggctatttagaattttatgaaagacataatagcataagaaattatgaatatttagacaaagtgatatcagttgaagaagcactactaaacatgtatgacattaaaacttatggttcaatttttattactgcatggggaaaattattccataaatctatattcaatgatttagaatttgcattaaataagtatcatgaggatgagttctttaactataaagcatacttaaaagctaattctataacatacatagacaagcctctctatcattatcgtatacgagtaggtagtatcatgaataatagtgataatgttataattgctagaaagaaacttgatgttttatcagcattagacgagcgaataaaacttataacaagtttacgtaagtattccgtttttttacaaaaaacagaaatattttatgtcaatcaatattttaggactaaaaaatttttaaaacaacaatctgtaatgtttaaagaagataactatatcgatgcttatagaatgtatggacggttacttagaaaagtgaagttagttgataaattaaaacttataaaaaataggtttttctagaaatggctgtttaatagttgtaatgtgagtgaccacgaattgttggataactatcaaaaagactaatttaggggaaaaataaaatgactaattttgtttgtcatactttataccatctactgattactataataaagttaaaagataaagaaaatactagaatatttatttgtgacactatcacggattatgaaacttgggtaaagatattaaatgatcagggaataagaactgaatcatttaaagagtttgcttatcgggagcagttacaaaataaaaatattgaagaagtgatggagcttgtagattcagacttaaatcactactttgagagagtagatacacaagtctatctatttaatgatgatactttaataggtcgctatatggtgtatttaggtaaaaattatcatctaattgaagatggttataactgttttcaagccaagttattcttgggtggttctgtcgtaaaacgagtaattaaaacttacttatttaaaaagtatgttccgtatggtttttcaaaatattgtctctcaattgaggttaattctttagtggggttacctcatgacataaggagtaagaaatataaagaactaccgagaaaaaaattatttgatagtcttaacaaagaacaaaaatcactgattttcaaaatatttaaaacaaaaccattaactataactccaaagtcagtattattgttgacacagccacttgcacaagataaatgttataaaacacctacagagaggtttcaaagtattcaagagcaatacgattattttgacgatattgtccaggaatatagaacgttagggtacaatgtttatttaaaagttcatcctagagatgtagtagattattccaaattgccggtagagctattaccatcaaatgttcctatggaaattatagagttgatgtcaacaggtcggttcgaatgtgggataacacattcgtccactgcgctggattttttaacttgtgttgataaaaaaataactttagtagatctgaaggatattaaatgaatactaagaaattacttcaatctggttttatttatacactcgggaatttattggtgcaaggattagcctttatcacacttcccatctatactcgggttatctcaacagaagtttatggccaatatagtttatatgtcgcttggatgaatattattatgctttttattggccttcagacgagcggttctttaagttcagcccgggtcaaatacggagaagaatttaaaagctattcagggagtgccttttctgtaggtaatatatggtttcttattatacttttgatagcttttctatttagaagttttcttgcaccattagttggtttttctgaatctatttttttattaatggtgtgtcaaagttacgctagctatgtggtgactttctttggtcagtattttatacaacaacagaggagtttggctaatttaatattatccttagccaatgcagtttcatctgttgcactatctctatttttaatttttcattggtccgatgactttttatctagggtttttggagcttttgttcctactataataactggaatagttgcctttgcttatatttattatcatagcaaatctttttacaatcctaagtattttcggttcattgtcactgtgtctgttcccttgattttccatttgttaggacaccagttgttggggcaattagatagaattatgctagctcgtttatacaatactaaagaagttgcaatgtatagtttcggttattcgcttggaatgattattcagattgttttgaatagtattaatatggcttggattccatggttttttgatgctagaaaagaaaaattactgcaactttcaacttatattagccgttatctctacttaggagttttcttaacattaggttatttgactgtttttcctgagttagctcaaataatgggaggagacaagtatagtagtagtgttcaatttatttctttaattattgtcagctactttttagtttttctctatacatttcctgtaaatatccaattcttctatgctaatacgacatggattcctattgggacattattagctgctggtgtaaattggttactaaaccttgtattaattcctcattatgcagcctatggcgctgctatggctacaataatatcttatttagccttgttgatttttcatcatattgtttcgaaagttaaataccattattcagatgtctcagttaggcagtacatcattttaagtggtatagtatttagttatgctatgttaatgaacatgttcctagataatatcgttattagatggagtttaggaataattattcttatagtatatagcattgtttttcaaaaagtcattttagacttattgagtaaaaaaagaaggagaagataatggtttatattattgcagagattggttgcaatcataatggagatattaatcttgcgaaaaaaatggtagatgttgccgtgtcttgtggtgttgatgctgttaaatttcagacttttaaagctgagaaacttatttctaaatttgctcccaaagctgaatatcaaaaagcaactacaggaacagcagacagtcaacttgagatgacgaaacgtttagagttaagctttgaagaatacttagaaatgcgtgattatgcaatttcaaaaggtgtggagaccttttcaacaccttttgatgaagagtcattagagttcttaatttctacagatatgccaatttacaaaattccatcaggagaaatcactaatttaccttacttagaaaagattggcaagcaacaaaagaaagttattctttcgacgggtatggcggtaatggaagagatccatcaagcggtgaatattttacgtcagaatggtacaaccgacatttctattttacattgtacaacagagtacccaacaccttacccctctctaaatttaaacgttattcatactttgaaagatgaatttaaagatttaacgataggttattcggatcattcaattggatcagaagtacctatcgcagcagcagcaatgggtgcagaagttattgaaaaacactttactttagatactaatatggaaggtccggatcataaagccagtgcaacacctgatattttagctgctttagttaaaggggttcgcattgttgaacaagccttaggtagatttgaaaaaatcccagatccagtagaagagaaaaataagattgttgctcgtaaatcagtcgttgctttaaaaccaattaaaaaaggcgatatttattcaatagaaaatattacggtgaagcgcccaggtaatggtatttctcctatgaactggtatgacatcttgggacaagaagcgcaagatgatttcgaagaggatgaagttattcgtgattcacgctttgaaaatcaattgcccgagttataataacacctaattataatcggcaacagatgtattacacggctaagattatgtaattactatatatagaagggatacgatgaaaaaaatttgtttagtaaccggatcgcgtgctgaatacggaataatgaagccattgattcaaagattatcaaaagataaagaagtcaacttacaaattattgcaacagcaatgcatctggaagaaaagtacggctatacttatcgtcaaattgaagaagacggttttgatattgcttataaagttcccttacatctttatgatactgacagaagaactgtatctactgcaatggcgcatttacaactaggattgaccaaaatttttgacaaggaagactatgatctagtcatcattttaggggatcgttacgaaatgttaccagttgtgaatgtagcgttgatttataatgtcccagtatgccaccttcatggaggggagacctcattaggcaattttgatgagtatattcgccatgcaattactaagatgagtcacctacacttagtctctacagaggactttcgtcaacgtgtgattcagatgggagaacaacctcaatttgtaattaacacaggagctctcggagtggaaaatgctctatcaatcccttctctaaccaaagaagcaatagaaaagcaattaggtattgtactagaggaatcctattttgttgttctctatcatcctgttacttttgaacaaggaaaaagtgctggagaacagatgaaagcggtactatcagccctttctaaatttggtgtccagtgtctatttataggatccaattcagatactggttctgatgatattgcaaaggctatcaatacttatttgataaatcatgaaaatagttattgctttgcttctttatcaacccaactttatcattccttaattcgtcattcactaggactgattggtaattcgtcttctggtttaatagaagttccttctttgatgaaacctactcttaatattggtgatcgccaaaaaggtaggctacatggagaaagtgtagtaagtgtaccagtcgaaaccccctctgtattggagggattatcaaaattgaatgaagtgaccaactttgacaatccctactacaaagagaatgcttcatctattgcatatgaagcaataaagctttatttgaaagatgaaccttcaatttcccaaccattttatgatttaaaggagaataatctaaaatgaaaaaaaagttggcatttttaggcgcaggaagtcatgctgatgcgattgctccggttattgatcctcttgtgtatgatttcgtaggtttttttgatgataaagatattacggagcatgatggttatcctgttcttggaaaactttatgatgtgctaccttaccttgaagatggctcaatagatgcagtatttattacaataggtgataatgctaaaaggaaagaactatttgaatatgtagcaaaggattattatgactttattattaacatcattagtcccaatgctttagtattgacaccagatagtatttgtgggcgtggtatctttattggttttggggcttttataggttctaaagtgaagctgtttgataacaacgttgttaatacaggagcgctcattgaacatcatactgttgtagaatcacactgtaatatagcacctaatgctaccataaatggtctttgttatattagagaagaagtttatgtaggtagtgccagtgttattattcaaaccttggatatttcatcgtgtacgacaattggcgcaggagctgttgttgtaaaagatattatagaacctggaacctatgtaggggttccagccaaaaaaataaaataaaggatatgttatgaagccaatttgtattattcctgcgcgatcagggtcaaaaggattaccagataagaatatgttattcctagcaggtaaacccatgattttccatactatagatgctgcaattgaatctggaatgtttgataagaaagatatttttgttagtacagattcagaattgtacagagagatttgtttagaacgcggtatttcagtggtgatgagaaaaccggaactttcaactgatcaggcaacttcgtatgatatgttaaaagattttttatctgactatgaagataatcaggagtttgtgttacttcaagtaacctctccactaagaaaatcatggcatataaaggaagcaatggagtattattcttcacatgatgttgacaatgttgtaagtttttctgaagttgagaaacaccctggtctgtttacgacattgtctgataaaggctatgctatagatatggtgggagcagataaaggttatcgtcgccaagatttacaacctttatactatccgaacggcgctatttttatttctaataaagaaacttacttaagggaaaaaagctttttcacctctaggacatatgcttatcaaatggcaaaggaattttcattagatgttgatacgagagatgattttatccacgtcatcggtcacctctttttcgattatgccattagggaaaaagagaataaagttttttataaagaaggctatagtcgtttgttcaatagagaagcttcaaagataattttaggtgattcaaaaacgatatctatctcactagaaaattaccataattattcccaaggtggtgtaacattagcaacgatgttggaaaacttacctaactttttgacagctaatgtaacagaggcttttgtttctataggggtaaatgatctcattacaggttatagtgtggaagaaatattcagcaatttccaaaaactctactcattattagctgagaataaaataaagatgagatttacaactattgcttacaccctttttagagaaactgtcaataatgcagatattgagaaaatcaatcaatggctaacagaattttgttatcaaaatcagattccactgttagatattaatagatttttatcaaaggatggtaatctaaattatcatttaactagtgatggattgcattttgactcaagaggctaatgatttgtaacaaagtcaatatcaattatttgtagacgaagttaaaaccttataatatttattttataaaattattcatcttattttggcgatttcaatagtgatatggtatatttaaagtaagctacgtatagttttaccagtcagaaatagtaaggatggttgagtatgagagaaactgaaacacacgatcaccaagcgctaattcaaaaattgttagtcagtattcattatttaaccttgtttcgtgatgaaattatattagtagaaaaaaccccatctttactggggaaacatttttctattgctattgtgcagaatgaactaggtgagatactttctaaaatagaagctttgagtaagcaaaaaaaactgattcgttctatttattggtatgatgaatcgtcatttaaagtcatgaataaggctctggctattgtagaagaatggattaagggcttagataatcttttagaattctgtcaatcacagacggtttttcaagcaattttaggtgatgaacgtgcacatgtatttggaatccttattgatgtttatacttctttaaacattataaatacttctttgaaagaagaaaattctaga

SEQ ID NO: 26 - protein, 381 aa, Streptococcus agalactiae
MRKYLDLDYSLFYALWVLILVPNQWYQFLIITIIVLLLLWKSEFRISISNSSILFLLWLFIYLFAILIRGTQEDITFQRFIAELLKLISTGYALFFYNYYRKADFNSSVVRNVVKVNYFVLFLITVLYLFFPMLKPTLFGRELFSIEWFPHMRIRLAAYFEYATLIGQFILFSYPILFLKPQKHMENILISLLLTICSYFSGARILLVCMLVLLASLLLDYILFKTNLKLTKKNTFILGMTFLFITACFSYNIWSIIEKIIMYRNQSTITRMIVYQESIIEVLKGNILFGQGIRIPSSEGIFLGSHSTYISVFYRTSLLGIVLYFSAFILLYKEAISKNYKIYRLFFYTLLCYTLFEEIDPNHWSIVLLFSTFGIVGRAKK

SEQ ID NO: 27 - DNA, 3042 bp, Staphylococcus aureus
  CDS (149)..(2296)
actattgtatattgcaaagctaattaactataacaaaaagatagttaatgctttgtttattctagttaatatatagttaatgtcttttaatattttgtttctttaatgtgtagattgggcaattacattttggaggaattaaaaaattatgaaaaagcaaataatttcgctaggcgcattagcagttgcatctagcttatttacatgggataacaaagcagatgcgatagtaacaaaggattatagcaaagagtcaagagtgaatgagaacagtaaatatgggacattaatttcagactggtatttaaaagggagattaactagtctagaatctcaatttatcaatgcattggatattttagagacatatcattatggcgaaaaagagtataaagatgcaaaagataaattgatgacaagaattttaggggaagaccaataccttttagaaagaaaaaaagtgcagtatgaggaatacaaaaaattataccaaaaatataaagaagagaatccaacctctaaaggcttaaaactgaaaacattcgatcaatatacaatagaagatttaactatgagggaatataatgagttaacagaatcattaaaaagtgctgtaaaagactttgagaaagatgttgaaaaaatagaaaatcaacatcatgatttgaaaccatttactgatgaaatggaagagaaggctacttctagagttgatgatttagcaaataaagcatatagtgtttattttgcatttgttagggatacacaacataaaactgaggcattagagttaaaagcgaaagtagatttagttttaggtgatgaggataaaccgcatcgtatttctaatgaaagaattgaaaaagaaatgataaaagatttagaatctattattgaagatttctttatagaaactggtttaaataagcctggtaatattacgagttatgatagtagtaaacatcactataaaaatcacagtgaaggttttgaggctctagtcaaagaaacaagagaagcagtagcaaacgctgacgaatcttggaaaactaaaactgtaaaaaaatacggtgaatctgaaacaaaatctcctgttgtaaaagaagagaacaaagttgaagaccctcaatcacctaaatttgataaccaacaagaggttaaaactacggctggtaaagctgaagaaacaacacaaccagttgcacaaccattagttaaaattccacagggcacaattacaggtgaaattgtgaaaggtccggaatatccaacgatggaaaataaaacgttacaaggtgaaatcgttcaaggtccagatttcccaacaatggaacaaagcggtccatctttaagcgacaattatactcaaccgacgacaccgaaccctattttagaaggtcttgaaggtagctcatctaaacttgaaataaaaccacaaggtactgaatcaacgttgaaaggtattcaaggagaatcaagtgatattgaagttaaacctcaagcaactgaaacaacagaagcttctcaatatggtccgagaccgcaatttaacaaaacacctaagtatgtgaaatatagagatgctggtacaggtattcgtgaatacaacgatggaacatttggatatgaagcgagaccaagattcaacaagccatcagaaacaaacgcatacaacgtaacgacaaatcaagatggcacagtatcatacggcgcccgcccaacacaaaacaaggcatcagaaacaaacgcatataacgtaacaacacatgcaaacggccaagtatcatacggagctcgcccaacacaaaagaagccaagcgaaacaaatgcatataacgtaacaacacatgcaaacggccaagtatcatatggcgcccgcccgacatacaacaagccaagcgaaacaaatgcatataacgtaacaacacacggaaatggccaagtatcatatggagctcgtccgacatacaagaaaccaagtaaaacaaatgcatataacgtaacaacacatgcaaacggccaagtgtcatacggagctcgcccaacacaaaacaagccaagcgaaacaaacgcatataacgtaacaacacatgcaaatggccaagtatcatacggagctcgcccaacacaaaacaagccaagcgaaacaaacgcatataacgtaacaacacacggaaacggtcaagtgtcatacggcgctcgtccgacatacaacaagccaagtaaaacaaatgcatacaatgtaacaacacatgcagatggtactgcgacatatggtcctagagtaacaaaataagtttataactctatccatagacatacagtcaatacaatacaaaacattacgtatctttacaacagtaatcatgcattctatgatgcttctaactgaattaaagcatcgaacaatcgaaagcatatttctaaattatttattcattatagtcttaaacataacatgacctaatatattactaacctattaaaataaaccacgcacatctatgtgatatacgacaatcacagcaataataattgctttagaaagtcgtaccgaactggaacttacaagtctagttcgaacacactgatgtgagtggttttctttattttaaacatgaacaatcagataagttactagcattagcaaatattattaaatcaaagggcttcgattcataaaatttaaaacaatgattaaaattagacgtgtaaatgttaaattctaaaacggaaatacccgctatcctattaaaccactttttggttcaatcactatatttcacacagcttcaataataaaacgaaactgcttcaatccgcttcaacttcaacctacctcattcagtaaccaaacgaatccgcttcatccaaaatcaaccattctaacgcacatactcaaatatagcagctgcacccataccgacaccaatacacatcgtaaccatgccgtaacggctatcgggacgtctacccatttcattaagtaaacgcgcggttaacattgctcctgtagcacctaatggatgacctaaagcaata

SEQ ID NO: 28 - protein, 715 aa, Staphylococcus aureus
MKKQIISLGALAVASSLFTWDNKADAIVTKDYSKESRVNENSKYGTLISDWYLKGRLTSLESQFINALDILETYHYGEKEYKDAKDKLMTRILGEDQYLLERKKVQYEEYKKLYQKYKEENPTSKGLKLKTFDQYTIEDLTMREYNELTESLKSAVKDFEKDVEKIENQHHDLKPFTDEMEEKATSRVDDLANKAYSVYFAFVRDTQHKTEALELKAKVDLVLGDEDKPHRISNERIEKEMIKDLESIIEDFFIETGLNKPGNITSYDSSKHHYKNHSEGFEALVKETREAVANADESWKTKTVKKYGESETKSPVVKEENKVEDPQSPKFDNQQEVKTTAGKAEETTQPVAQPLVKIPQGTITGEIVKGPEYPTMENKTLQGEIVQGPDFPTMEQSGPSLSDNYTQPTTPNPILEGLEGSSSKLEIKPQGTESTLKGIQGESSDIEVKPQATETTEASQYGPRPQFNKTPKYVKYRDAGTGIREYNDGTFGYEARPRFNKPSETNAYNVTTNQDGTVSYGARPTQNKASETNAYNVTTHANGQVSYGARPTQKKPSETNAYNVTTHANGQVSYGARPTYNKPSETNAYNVTTHGNGQVSYGARPTYKKPSKTNAYNVTTHANGQVSYGARPTQNKPSETNAYNVTTHANGQVSYGARPTQNKPSETNAYNVTTHGNGQVSYGARPTYNKPSKTNAYNVTTHADGTATYGPRVTK

SEQ ID NO: 29 - DNA, 2252 bp, Staphylococcus aureus
  CDS (698)..(2224)
gaattcacaattctagctattatcacttctcaaaataaaaacatcgttcttcttaaagatttaattgaaacaatccaccataaataccctcaaactgttagagctctcaataatttaaaaaagcaaggctatctaataaaagaacggctcaactgaagatgaaagaaaaattttaattcatatgaatgacgcgcagcaagaccatgctgaacaattattagctcaagtgaatcaattattggcagataaaaatcatttacatcttgtttttgaataatatctctattacgcaagtgtgctgtattctaaagtgccattgtgttttctattttttaataaaacctcagcacattatgaacaactttctattttctatatctcttaaaaccatttccgaaattaaacctcagcacattcaaaattccattttattcttaaaaatattttttaactcatatgtaataaaccgctttcattataaaaaatatctatatattttatctgtttttattaatcggaatagcgtgattttgcggttttaagccttttacttcctgaataaatctttggacaaaatttttattttataagttgtaaaacttacctttaaatttaattataaatatagattttagtattgcaatacataattcgttatattatgatgactttacaaatacatacagggggtattaatttgaaaaagaaaaacatttattcaattcgtaaactaggtgtaggtattgcatctgtaactttaggtacattacttatatctggtggcgtaacacctgctgcaaatgctgcgcaacacgatgaagctcaacaaaatgctttttatcaagtgttaaatatgcctaacttaaacgctgatcaacgtaatggttttatccaaagccttaaagatgatccaagccaaagtgctaacgttttaggtgaagctcaaaaacttaatgactctcaagctccaaaagctgatgcgcaacaaaataagttcaacaaagatcaacaaagcgccttctatgaaatcttgaacatgcctaacttaaacgaagagcaacgcaatggtttcattcaaagtcttaaagacgatccaagccaaagcactaacgttttaggtgaagctaaaaaattaaacgaatctcaagcaccgaaagctgacaacaatttcaacaaagaacaacaaaatgctttctatgaaatcttgaacatgcctaacttgaacgaagaacaacgcaatggtttcatccaaagcttaaaagatgacccaagtcaaagtgctaaccttttagcagaagctaaaaagttaaatgaatctcaagcaccgaaagctgataacaaattcaacaaagaacaacaaaatgctttctatgaaatcttacatttacctaacttaaatgaagaacaacgcaatggtttcatccaaagcttaaaagatgacccaagccaaagcgctaaccttttagcagaagctaaaaagctaaatgatgcacaagcaccaaaagctgacaacaaattcaacaaagaacaacaaaatgctttctatgaaattttacatttacctaacttaactgaagaacaacgtaacggcttcatccaaagccttaaagacgatccttcagtgagcaaagaaattttagcagaagctaaaaagctaaacgatgctcaagcaccaaaagaggaagacaacaacaagcctggtaaagaagacggcaacaaacctggtaaagaagacggcaacaaacctggtaaagaagacaacaaaaaacctggcaaagaagacggcaacaaacctggtaaagaagacaacaaaaaacctggcaaagaagatggcaacaaacctggtaaagaagacggcaacaagcctggtaaagaagatggcaacaagcctggtaaagaagatggcaacaagcctggtaaagaagacggcaacggagtacatgtcgttaaacctggtgatacagtaaatgacattgcaaaagcaaacggcactactgctgacaaaattgctgcagataacaaattagctgataaaaacatgatcaaacctggtcaagaacttgttgttgataagaagcaaccagcaaaccatgcagatgctaacaaagctcaagcattaccagaaactggtgaagaaaatccattcatcggtacaactgtatttggtggattatcattagcgttaggtgcagcgttattagctggacgtcgtcgcgaactataaaaacaaacaatacacaacgatagatatc

SEQ ID NO: 30 - protein, 508 aa, Staphylococcus aureus
LKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNKPGKEDNKKPGKEDGNKPGKEDNKKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31 - DNA, 324 bp, Staphylococcus aureus
  CDS (1)..(306)
  CDS (310)..(315)
atgcggggttctcatcatcatcatcatcatggtatggctagcatgactggtggacagcaaatgggtcgggatctgtacgacgatgacgataaggatccgagctcgagaggatccaaagctgatgcgcaacaaaataacttcaacaaagatcaacaaagcgccttctatgaaatcttgaacatgcctaacttaaacgaagcgcaacgcaacggcttcattcaaagtcttaaagacgacccaagccaaagcactaacgttttaggtgaagctaaaaaattaaacgaatctcaagcagggaaactagtttagaaagcttgatccggc

SEQ ID NO: 32 - protein, 104 aa, Staphylococcus aureus
MRGSHHHHHHGMASMTGGQQMGRDLYDDDDKDPSSRGSKADAQQNNFNKDQQSAFYEILNMPNLNEAQRNGFIQSLKDDPSQSTNVLGEAKKLNESQAGKLVKA

SEQ ID NO: 33 - protein, 60 aa, Staphylococcus aureus
TADNKFNKEQQNAFYEILHLPNLNEEQRNGFIQSLKDDPSQSANLLAEAKKLNDAQAPKA

SEQ ID NO: 34 - DNA, 2593 bp, Homo sapiens
  CDS (56)..(508)
agttgtctttggtagttttttgcactaacttcaggaaccagctcatgatctcaggatgtatggaaaaataatctttgtattactattgtcagcaattgtgagcatatcagcatcaagtaccactggtgtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcattccttcattctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttcgatttcccactgaaagagttatttgttgtaagtagagttatcccggagaaggaaaaagaacttacgacctttctttataacagaaagctcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaaggactgtgactatacagtgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttcgatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaatttttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 35 - protein, 150 aa, Homo sapiens
MYGKIIFVLLLSAIVSISASSTTGVAMHTSTSSSVTKSYISSQTNDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 36 - DNA, 5185 bp, Homo sapiens
  CDS (104)..(4474)
gggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacagactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaagcgaggaaaagctgccaacaacagaacgctgagctcctgagcatcacagagatacatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatttcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaataaaaaaaaaaaaaaa

SEQ ID NO: 37 - protein, 1456 aa, Homo sapiens [sequence omitted]

SEQ ID NO: 38 - DNA, 780 bp, Homo sapiens
gtgtatctctcagagtgcaagactgggaatggaaagaattacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacatgaaaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagta

SEQ ID NO: 39 - DNA, 1449 bp, Homo sapiens
  CDS (1)..(1449)
atggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtga

SEQ ID NO: 40 - protein, 482 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 41 - DNA, 852 bp, Homo sapiens
  CDS (59)..(463)
cttgcagctgcccacctcaccctcagctctggcctcttactcaccctctaccacagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggactgagcggtcacagacccctaaagggccatagcccagtgagcagcctggagccctggagaccccaccagcctcaccaacgcttgaagcctgaacccaagatgcaagaaggaggctatgctcaggggccctggagcagccaccccatgctggccttgccacactctttctcctgctttaaccaccccatctgcattcccagctctaccctgcatggctgagctgcccacagcaggccaggtccagagagaccgaggagggagagtctcccagggagcatgagaggaggcagcaggactgtccccttgaaggagaatcatcaggaccctggacctgatacggctccccagtacaccccacctcttccttgtaaatatgatttatacctaactgaataaaaagctgttctgtcttcccacccgc

SEQ ID NO: 42 - protein, 134 aa, Homo sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 43 - DNA, 6788 bp, Homo sapiens
gctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggaggtaaggagcagggcttgcaaaccgcccggcgcccagggaagcgacgagcgccggggcaaggcaagccctggacgggattgcgacgtgcgcaccgggcgccctaatatgcccgggggactgtttctgcttccgaaacaaaaccatctctgggttttcccagaaaagccagttccagccccgaaggcatcctggctagaggagacccgccctaatccttttgcagcccttaccggggggagtaatggcttctgcgaaaagaaattccctcggctctagaagatctgtctgtgtttgagctgtcggagagccggtgcgtccccaccccaggctggggttcttctccaaagggtgcccctggaggaagaagagggggggattaggcagggcgaggccgccgcggtcgcaatctgggtcacggctgctccagcttggaggagaggcggctctcccggcgacctcctcgcgcgcggcgcccctgccattcccgggaacaggggctcagcctctccctccctggaagaggacgttgtcgtggtttggaagagcaggggtgggcttagagcttccaattaagctattggcaggagtatccctgcagcgggtgaatgccgaggggcgtttgcccaaatttggggaggggaaggatttgtggatatgggtgtctgttgttggtctctgtctagagaaaggcttttttttatttgcaaagttttctaaatcccctgctatcatttgcactcctgaggttgcatttttacaaagggggtagaaggtactccaaataccattcccggtagctgggtcggagagcctggggcttcccctgagcagccggccccacaccgctgcgagtgcggttgtctgcgtgctcgtgagagctagaattctgcagccaggaacagccccctcccccaggcagtgccttgtgtgaatgaaatggcagtttccaaagttgcggacgcctcgccaccaccccctgcatctgcatgccccctcccaccccctgtcgtagacagcttgtacacaaaaggagggcgggagggagggagcgagaggcacaacttcctccaccttcgggagcagtgggcagagtggggggcttggagggaagattggggaacctggttagagggggcgcccattgcctatcccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcaggtaaagaccgaactcgggtccggctgcctccctggggcactggaccccgggtcgcgtcccctttgttagtgctcgtatgtcttggcctggggagcattttggaggcagtgctaggggcagagaggtcctgtttcccccaagtctctcctcggggtaaagagaaggggctgagagaatgccgttgcaaaaggggtgctctccaattctcgccttcactaaagttccttccaccctctcctggggagccctcctctaggccatcacgggccctcacccggtcccccacctctcttttgcaggcagtctgaggaataaaattggagaagttggtggctaaaccgggtgggggtttagggggttgctgggtgcactgcctggacagaaacctgattgcgcaggggtgaaagggactctctggcccaggtcaggggagggaaagacatcccgagaagattcaagggctgtgcaaagccctgtttaaggcgcaggaacttataggagggttgcacagatggctagagccgattttctattctttttctttttctttttttttttttttcaaatgtcggtacctttcccttcccccatcctcggtgggtggtgggctatttgctcctgttcgtggccagcaggcggcgatatgcgaggccagcaggcgggcccgggatctgaaaggctgggggtggtgggggcaccctccctccctccattcagcagctggctgcaagtgcaacagcagttgtgtacattctcagggggcctcctctttccagtgtgcagtggaaactggctgtagttttgtcttccagcctgaattccaggcctaatttgagatgtgagttgtatctaacccagtgcccttgaaggtgagggcaggcactcagcagcctctccaggaaggctcacatcctgggaggactcactgattagttctattgtgttcatttgtctgtgtcttaagctgaagggaagagttaaaaccaagcctttccctgggggtctggatgaacagaactcaacccaaagagtggcattgccttgtccttggagcagggagctgggaccccccttggactttgaaaacagtgttttcagaatgcaggtggataacaagcctaaatttacttctgggctgaggagagatctttgaggctcctggaaggaaacttggtgataagcctccagtttgaaacggctctgtccctttaatgtctgtgccttgacagcttttggtgaggaagcacttccttccaacagctgtcttcttggcagaaaaccaaaacattggcttaaagggacccacagactggaacagcctcacatttcggctttagaacaaatcccacaattgttcagctttccggtccccttcagatcaagcagaagatatgttttgattttcatgcttgtattttaaacaataattttctaccccagcgtggtagtcaatgaggagagaggggaagaatgcgcacatgatgctacacgtttctgttgttgctgttattattggtggctttgaggagagctgctcccatttggggtttataccaactgtggattatggctttgtcattaagatttgatctttgttaaatgaaaaactgtttattgtataaaactcaggtttgtggacgaaaagttgttttttttcttcagttaattaaattgttcctcaagtttgtttaaggacttaaaatcaaacacaaccatgtgtaaactgctaaatgaggctcctaaaatgagaggcctcaactctttaagtgtggagctagaaatgtaaataagtccacagggcagactggtgattatgataaaagctaccatttactgagcatctgtctactaggctcagctctatgctaagtctacatgttatctgtcaaagtggtatcatccccatttaatagctgaggaaacagaggcttagaaaggctgggtaacttgaccagggtcatgcaactagtctgcggtggagccaggattctgtctgaccctaaaggccaaggttctttatatttatttctaccacctgctaaagtcttgaatggaggctgaaagcacagttggggtatggggaaagaaaatatatatacatacatatatgtatatgtatgtatgtatgtatggggggttgttttgtttttgtttttgataaggagttttgctcttgttgcccaggctggagtgcagtggtatgatctgggctcactgcaacctccgccacccgggttcaagtcattctcctgcctcagcctcccgagtagctgggattaccggagcatgccaccacacccagcaaagttttgtatttttagtagagacagggtttcaccatgttggccaggctgatcttgaactcctcatctcaggtgatctgccgcctccgcttcccaaagtgctgggattacaggtgtgagtcaccgcgtccggcctacagatatatttaatttaaagatctaaaacaaatacaaaactgtccacatctatgttgatggacccataaaaatagcagtctgccagggtctgccggaagagacagataagcatacatattaacatggatatatatgtgaatttcattcaaatggttctcacatgagagtaactagcatctttctctcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtgccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttcatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgatgcaactcaaccttttccttaatggcattacactctgcccttaaggagcaaccataaataatccataacctatagagggaatttggtttccgtaaatagccctttttgcacctgtacaatcctggttggggggcatgagtcatgtccccacttaaggtggagggaactgagtttggggaaattaaggcagttctccaagattatgcagaatagagatgttattagcgact

SEQ ID NO: 44 - DNA, 6107 bp, Staphylococcus aureus
  CDS (2507)..(3778)
  CDS (3813)..(4529)
agatctatcaaggatgtgatgttatgaaagtccaaatttatcaattaccgattgtttttggagatagttctaaaaatgaaactcaaataacgcaatggttcgaaaaaaatatgaatgctgaagtagatgtagtcgttttacctgaaatgtggaataatggctatgatttagagcatttaaatgaaaaagcagataataatctaggacaaagtttttcatttattaaacatttagctgaaaaatataaagtcgatatcgtagctgggtctgtttctaacattagaaacaatcaaatatttaatacagcttttagtgtgaataaaagtggccagctgattaatgaatacgacaaagttcatttagttcctatgttaagagagcatgaatttttaaccgctggcgaatacgtagctgaaccctttcaattgtctgacggtacttatgtgacccaacttatctgttatgatttacgttttccagaattattaagatatcctgctcgtagtggtgctaaaattgcattttatgtggcgcaatggcctatgtcacgtcttcaacattggcattcattactaaaggcacgtgcaattgaaaataatatgtttgtcattggaactaatagcactggattcgatggtaacacagaatatgctggtcattcgatagttataaacccaaatggagatttagttggagaattaaatgaatccgcagatattttgactgtagatttaaacttaaatgaagtagaacagcaacgcgaaaatatacctgtatttaaaagtattaaattagatttgtataaataagaagcgcccgaaataatatttaacacatgtcatgactaaacatagatttatgagagatttttcataagtctatgtttatttttttataatagataactcagtaagaacccatttcgccctttgcaaatgaatgattttcttaattaaattgattaattttttgaccttttccaacattagacttattcatatattttaacggcgggtctcataatgatgattaactcatcccttcttcattacaaaaaaggccgcgagcttgggaggggctcacgaccatacttattattaagggaatgttttacagttattttttcaatctatttttggggatgttattaattatgaaaaaaattttatttatcaaataatgataaatcgatgttgtttacgatagcttacatgctagaaataattatctgtaatgataattaagaaaaatacatagcactgagtccaaggaaactaactctactagcaaatgttactcacttgctaattttacatggttattaagttgggatggcttaataactcatacttttagtactatacgaagataacaaatttacaatgaaagtaattaattattcatcttattttttagtgaatttgttcactgtgtcgataatccattttactaagtcaccgattgttgaaatgatatcttgtgccattgaaatcactccttccttaattaagataaaaattcttaaaattaaacaactcatcaactattttccatcacatctctgtgatctagttatattaaaacatgctaaaagcatttattttccaatttttcttaactagtcgttttttattcttaactgtaaatttttttatgttaaaatattaaatacaaattacatttaacagttaagtatttatttcctacagttaggcaatataatgataaaagattgtactaaatcgtataatgacagtgaggagagtggtgtaaaattgaattattttgataataaaattgaccagtttgccacgtatcttcaaaagagaaataacttagatcatattcaatttttgcaagtacgattagggatgcaggtcttagctaaaaatataggtaaattaattgttatgtatactattgcctatattttaaacatttttctgtttacgttaattacgaatttaacattttatttaataagaagacatgcacatggtgcacatgcaccttcttctttttggtgttatgtagaaagtattatactatttatacttttacctttagtaatagtaaattttcatattaactttttaattatgattattttaacagttatttctttaggtgtaatctcagtatatgctcctgcagcaactaaaaagaagcccattcctgtgcgacttattaaacgaaaaaaatattatgcgattattgttagtttaacccttttcattatcacacttatcatcaaagagccatttgcccaattcattcaattaggcatcataatagaagctattacattattacctattttctttattaaggaggacttaaaatgaatacattatttaacttattttttgattttattactgggattttaaaaaacattggtaacatcgcagcttatagtacttgtgacttcataatggatgaagttgaagtaccaaaagaattaacacaattacacgaataatttaaatagagagtgtgatagtaggtggaattattaaatagttataattttgttttattcgtattaactcaaatgatattaatgtttacaataccagctataattagtggtattaagtacagtaaacttgattattttttcatcatagtaatttcgacattatcgttatttctatttaaaatgtttgatagcgcgtccttaatcatattaacttcatttattattataatgtattttgtcaaaatcaaatggtattctattttgttgattatgacttcgcagattattctatactgtgctaactacatgtatatagttatatatgcatatatcaccaaaatttctgatagtatatttgtaatattccctagcttttttgtagtttatgtgactattagtatactattctcatatataataaatagagttctcaaaaaaattagcacaccatatctaatactaaacaaaggatttttaatagttatttcgactatcttactgcttactttttcattatttttcttttattcacaaataaactcggatgaagctaaagtaataaggcagtattctttattttattggtatcactatattttaagtatattaacattgtattctcaatttctccttaaagagatgaaatataaacgtaatcaagaagaaattgaaacctattatgaatatacattgaagattgaagctatcaacaacgaaatgcgcaagttccgtcatgattatgtcaatatcttaacgacactttcagaatacattcgagaagatgacatgcctggcctacgtgattatttcaataaaaatattgtacctatgaaagacaatttacaaatgaatgctataaaattaaatggtatcgagaatcttaaagtacgtgaaattaaaggcttaattactgcgaaaattttacgtgcacaagaaatgaatattccgattagtatcgaaatacccgatgaagtaagtagcattaacttgaatatgatcgatttaagtcgcagtattggtattattcttgataatgcaattgaggcatcaactgaaattgatgaccctatcattcgcgttgcatttattgaaagtgaaaattcagtaacgtttattgttatgaataaatgcgctgatgatataccacgcattcatgaattgttccaagaaagtttttctactaaaggtgaaggtcgtggtttaggtctatcaactttaaaagaaattgctgataatgcagacaatgtcttattagatacaattatcgaaaatggtttcttttattcaaaaagttgaaattattaacaactagccataaggatgtgaatgtatgaaaattttcatttgcgaagacgatccaaaacaaagagaaaacatggttaccattattaaaaattatataatgatagaagaaaagcctatggaaattgccctcgcaactgataatccttatgaggtgcttgagcaagctaaaaatatgaatgacataggctgttactttttagatattcaactttcaactgatattaatggtatcaaattaggcagtgaaattcgtaagcatgacccagttggtaacattattttcgttacgagtcacagtgaacttacctatttaacatttgtctacaaagttgcagcgatggattttatttttaaagatgatccagctgaattaagaactcgaattatagactgtttagaaactgcacatacacgcttacaattgttgtctaaagataatagcgttgaaacgattgaattaaaacgtggcagtaattcagtgtatgttcaatatgatgatattatgttttttgaatcatcaacaaaatctcacagactcattgcccatttagataaccgtcaaattgaattttatggtaatttaaaagaactgagtcaattagatgatcgtttctttagatgtcataatagctttgtcgtcaatcgccataatattgaatctatagattcgaaagagcgaattgtctattttaaaaataaagaacactgctatgcatcggtgagaaacgttaaaaaaatataataagataataaagtcagttaacgacgtattcaattgtaaatcttgttggattttaacaagataactagcaaatgcactgtatagctggctttttaattttattaacaaaattaaatatgacgcgtgaattaaaaaatgatgtaacgtctctttgtatacctattcctattactacataatttatcaatttctatttcactctacaatcctatggcgcaatttttaacaaaatatactaaatttgaaattgacagtttccataaataaaatgctataatttcctactccgtgaatcttattttgtttaaaaaaacagtgtagcacaagattcaacttgtttcctacactgttttataaatgaattatttaaaatgcttgttcaacctcttgtaatgttggcaaactattaatagcaccatacttcgttgtcactattgcagcaacgcgattgctaaacgctaaaatttcctcaccttcattttcaaataactgagttaaatttaacacatcggttgctaaaatcctgctaataactgcaccaataaatgcatcccctgccccagttgtatcaacaggttttaccttatagccactatgataatgattaataccatttttcaaatatacggcagcaccatctgctcccttcgtataaatgactacagtaacattacctgtaaataatgattgaatggcttcattttcatcatgaatacctgtaataaattctaattcttcatctgaaacttttacaatatgcgccaatggcaaaaaggtatgaatagtttgtcttaaatcttcagcgttatcccataatggcaatcttacattaggatcaaatacgacagtaccatttgcatttaatgttttggtaatcaattgataatgtgcatctctcatcggactatcgaccaaatcaacagaacaaaaatgtactacatcattttcattcacatcaatatcattcacaaaacttggttcaaataacatatcagcagagggcttacgataaaaagaaaaatctcgctcgcccgcttcagtcaaactcacaaaagctaacgcagtgtttgcttcattcgtgcgatacacttttgatacatctacaccaatacttgatatcgtttcaataatgctatctccaaatgcatcattacctaattgtgtaatcatatacgcttgttgtcctaacttttgaactgtacaagctacattgcatggcgcgccaccaatttgcttcgtaaatgtttgaacatcttttaaattcgcatttgtaacatttggaataaaatcaattaacgcttctcctattgaaaatagacgtctcatttatgttcatcctttaaatcatatttagtaaattgtaaatatacttgccctgattctgttgatgttttaatacctagtgcgtcttctgtcgggaaaattcgagatgtcaaaacacgttctccatcattacagaaaatttctatactagatgtatcaacaaaaatttgtaattgctttaatggcgtgtctaatatcgtactacgcgtcgtaccttcaacatttgtcggcaataaaccactgtcgctgcgatcc

SEQ ID NO: 45 - protein, 423 aa, Staphylococcus aureus
VELLNSYNFVLFVLTQMILMFTIPAIISGIKYSKLDYFFIIVISTLSLFLFKMFDSASLIILTSFIIIMYFVKIKWYSILLIMTSQIILYCANYMYIVIYAYITKISDSIFVIFPSFFVVYVTISILFSYIINRVLKKISTPYLILNKGFLIVISTILLLTFSLFFFYSQINSDEAKVIRQYSLFYWYHYILSILTLYSQFLLKEMKYKRNQEEIETYYEYTLKIEAINNEMRKFRHDYVNILTTLSEYIREDDMPGLRDYFNKNIVPMKDNLQMNAIKLNGIENLKVREIKGLITAKILRAQEMNIPISIEIPDEVSSINLNMIDLSRSIGIILDNAIEASTEIDDPIIRVAFIESENSVTFIVMNKCADDIPRIHELFQESFSTKGEGRGLGLSTLKEIADNADNVLLDTIIENGFFYSKS

SEQ ID NO: 46 - protein, 238 aa, Staphylococcus aureus
MKIFICEDDPKQRENMVTIIKNYIMIEEKPMEIALATDNPYEVLEQAKNMNDIGCYFLDIQLSTDINGIKLGSEIRKHDPVGNIIFVTSHSELTYLTFVYKVAAMDFIFKDDPAELRTRIIDCLETAHTRLQLLSKDNSVETIELKRGSNSVYVQYDDIMFFESSTKSHRLIAHLDNRQIEFYGNLKELSQLDDRFFRCHNSFVVNRHNIESIDSKERIVYFKNKEHCYASVRNVKKI

SEQ ID NO: 47 - DNA, 7499 bp, Escherichia coli
  CDS (444)..(1475)
  CDS (1478)..(2590)
  CDS (2592)..(3386)
  CDS (3426)..(4361)
  CDS (4375)..(5481)
  CDS (5484)..(6503)
  CDS (6543)..(7487)
atagtaaatagctgacttatggatgtgctggggattctatgtatttagctgtggctttaccattacttttcccgtttttgacttaaatagcttcagtttggtctgatctgccgctacatcttcattttttttgtatttttatgcgattcattgaaactcggccccattttcaaatctacataggccgtactgacattatcgaaatgctattttttatctatttgatttttatgattaaagtatattttgtgtataaaaatcattcgggtcggattgctgcgaaagaaatgatacactagcacgtcaaagtaagtgcgttatcagtattcaggtagctgttgagcctggggcggtagcgtgcttttttctgcttaacttaaccagacaatcacacaaaagagtcgctagtggaaaagccatttcgaaaaatcctggtcataaagatgcgatatcatggggatatgttattaactactcctgtcatcagtacgctcaagcagaattatcctgatgcaaaaatcgatatgctgctttatcaggacaccatccctattttgtctgaaaacccggaaattaatgcgctctatgggataagcaataaaggtgcgggaactttcgataaaattaaaaatgtgctttcgttgataaaaactctgcgtgcgaataattatgacctggtcattaatcttacggatcagtggatggtggcgctgctggtacgttgtttacctgcacggatgaaaatatcgcaactttatggtcatcggcagcatggtatttggaaaaaaagcttcacacacttagcgccaatacacggtacacatattgttgagcgtaatttatcggtccttgagccattaggtattaccgatttctacaccgacacaacaatgagttacgccgaagattgctggaagaagatgcgccgggaattagatgccctgggcgtaaaagatcattatgttgtcatccaaccgacagcgcgtcagatatttaagtgttgggataacgataaattttctaaggttatcgatgcgctgcaacagcgaggctatcaggttgtgctaacctgtgggccctcggcagatgatctcgcttgtgtagatgagattgcacgaggttgcgaaacaaaacccattactggccttgcaggtaaaacacgttttcctgaactgggtgcattaattgatcatgcagtgctttttattggtgtggattctgcgccgggacatattgcagcggcagtgaaaacgccagtcattagtctatttggtgcaacggatcacgtattctggcgtccctggaccgagaatattattcaattctgggcggggaattatcagaaaatgccgacccggcatgaacttgaccgcaacaaaaaatatctttctgttatcccagcggaggatgtgatcgccgctacggaaaagctgttgccagaagatgccccttcagctgacaggaatgcacaattatgatcgtggcgttttgtttatataaatattttccatttggtgggcttcaacgtgactttatgcgcattgcatcaacagttgccgcacggggccaccatgttcgggtatatacacagtcgtgggaaggcgattgcccgaaagcatttgagcttattcaggtgccagttaagtcccataccaaccatggacgcaatgcagaatattatgcctgggtacaaaatcatctcaaagagcatcccgcagatcgcgttgttgggtttaataagatgcctggcctggatgtttattttgccgctgatgtttgttacgccgagaaagttgcgcaagaaaaaggttttttatatcgtttaacatcacgatatcgccattatgccgcatttgagcgagcgactttcgagcagggtaaatcgacgaaacttatgatgctgaccgataagcaaatcgccgatttccagaagcattatcaaactgaacctgaacgttttcaaattcttcctcccggtatttatccggacagaaaatacagtgagcaaatcccaaacagccgtgaaatttatcgccagaaaaatggcataaaagagcaacaaaacttattactgcaggttggatcagattttggccgtaaaggtgtagatcgctcaattgaagctttggcatcgttaccggaatcattacgtcacaatacgcttttatttgttgttggtcaggataagccgcgaaaatttgaagcgctggcagaaaaactcggcgtgcggagcaatgtgcatttcttctccggtcgcaatgatgtgtcagaattaatggcagccgctgatttattactgcatcccgcttatcaggaagccgcgggtatcgttcttctagaagcgatcactgctgggttacctgttttaacaacagcggtatgtgggtacgcgcattatattgcggatgccaattgtggaacggtcatcgctgaacctttctctcaggaacaattaaatgaagttttacgtaaagcgttaactcagtcgccattgcgaatggcctgggcggagaatgctcgccattatgccgatactcaggatttgtatagcttgccagaaaaagccgcggatatcattacaggtggtttagatggttgaattaaaagagccgcttgccacactttggcgtggtaaagatgcttttgcagaggtcaaaaaactgaacggcgaggtctttcgtgaactggagactcgtcgtacattacgctttgaactgtccgggaaaagctattttcttaaatggcacaaggggacgacattaaaagagattataaaaaatctactctcattgcggatgcccgttttgggcgcagacagagagtggcacgctattcatcgcctgagtgatgttggcgttgatacaatgaagggcattgggtttggcgaaaaagggttaaatccattaactcgcgcatcatttattattaccgaagatctcactcccacaattagccttgaagattattgtgccgattgggcagtcaacccgcctgatatacgtgttaagcgtatgctgatcgcacgtgtagcaactatggtgcgtaaaatgcatactgcagggataaatcaccgcgactgttacatttgccactttttgcttcatttgccatttactggccgggaagatgaattaaaaatttcagttatcgatctgcatcgggcacagatacgtgcaaaagtaccgcgccgctggcgcgataaagacctgattggtttatatttctcatcaatgaatattggcctgacgcaaagagatatctggcgatttatgaaggtttattttgggatgcctttacgcaaaatattgtctcttgaacagaatttattgaacatggcaagcgttaaggccgagcgtattaaagagcgaacacaacgcaaaggattataaaaatatttattagtatgtactggaactaactttattatgactatttattttataaattgggttgcagattatgaattaaaaatgattcagtacctgaaaaaaaagtacaagataaaaaatataacaacaccaaaaaaatataactggattaataaaaaaatatcaaaaatagggatggataatgcatggctggggcgattattcatcaagcattacctcaatgatattaaaaaagatgacataattatcattaatgacagtgttgttaataaaggtatcaataaacaaatattaaaaaatattaactgtcataaagttttgcttctaagaaatactgttggcgaagattttattcttgataacgcgaattatttcgatattatatatgattttgagcatagatttatagggaatgaaaagatcaaggcaatagaacaattttttcctataggaatggatgaaattagaaattatagtttatctgacaaaaataacagccagccaatatgttttttccttggtcgtgataaagggcgtcttcaaataattaatgagttagccgagagattaacaacactaggatgtaagctagattttaatgttgtcaaagataagacatcatctacgacttcaaagtatttgattgaaaaacaaatatcttatgaagagaatattagaagaacattaaatgctaatataattgttgatataaccaaagaaaaccaatctggctggactcttcgtatacttgaggcactatttttcaataaaaaattaattactaataatataaatgtatttggttcagaaatctatagtgaatctcgcttttttataataggtcatgatgattgggataagttagagtattttattaactcatctgttaaaccaatggattatgatagtttatataaattcagtccagataaaatgatgtcaacgattgtttctgattttatagacaaataaaaccgttaaaacagtgagttttactcaattaatgagagtttctatgaaaatagcgtttatcggcgaagctgtttctggatttggcggcatggaaactgtcatccgtgatgttattactaccttcaggcaacaacatatccaaagtgaaatgtttttcttttgtcgtaatgacaaaatggataagggatggctggaaggtattaaatactcatgttcattttccaatattcgtttaggttttttgcgtcgggcgaaacatattcatgctctaagtaaatggcttcaggagtaccaaccagatatcgttatttgtattgatgtgatctcctgcctgtttgccgcaaaagcacgtaaaaaatcaggaattgatatgccagtattttcatggccacatttttctttagatcacaaaaaacatgctgaatatatcacctgtgccgactatcatttagcaatcagctctggcattaaacagcaaatgattaatcgaggtgtagcagaatcgacgataaatgttatttttaatcccgtcgaaactaaagactcagtcattcccgcgcccgaggaaggtgaaacggcaacgtttatttatgttgggcgtatgaaatttgaaggccagaaaagagttaaagacctgcttgatggcttatcacaagcgaaaggtaactggaaactccatgtattgggtgatggctccgatttcgaaaaatgccaggcttatggtagagaattaaatattgatgatcgaattgtctggtatggttggcaacaatatccctgggaattggtccagcaagatattgaaaaagtgagtgcgttattgctcacgtcatcttttgaaggtttcccaatgaccctacttgaagccttgtcgtgggggattccttgtatcagtgccgattgtgtctccgggcctgctgacattattcaacctgatgtcaatggccatctgtatcaaccgggagatattgctggttttgtaactcttctaaataaatatatagcaggtgaaattcatatcgaacatgaaaaaattcctgcgtcgatcgatgaattttaccaatcgaagtattacgatagattacataaggtaattatttctgctatttcccggaggaaataatgcagcaggtgtttttccaggaaactgagtttcttaattcagttattgattatgatcataaagtagaaacagaaaatctttgtctggacatcgcttatggaactgacaaaaactttctatttggttgcggaatttcgattgcttcaatattaaaatataatgaaggaagtcgattgtgtttccatatttttactgattattttggtgatgatgatcgtaagtattttgatgccctggcgttgcagtataaaaccagaattaaaatatatctgattaatggtgatcgactgcgctcattgcctagcactaagaattggactcatgcaatatattttcgttttgttattgcagattactttattaataaggcgcctaaagtcctttatctggatgcagatatcatttgtcaggggactattgagccactaattaatttctcatttcctgacgataaagtcgcaatggttgttacagaagggcaagctgactggtgggaaaaacgcgcccattcgttaggtgttgcgggaattgctaaaggttactttaactccggttttttattgattaatactgcccaatgggcggctcagcaggtttctgcacgagctattgcaatgctaaatgagccagaaataatcaaaaaaataacacatcctgatcaggatgtgttaaatatgttgctggcggataaacttattttcgctgatattaaatataacacccagttcagcttaaattatcaactcaaagaaagctttataaacccagtaaccaacgatactatttttatccattatatcgggccaaccaagccctggcatgattgggcctgggattatcctgtatcacaagcctttatggaggcaaaaaatgcttcgccatggaagaatacggcgttgctgaaaccgaacaatagcaatcaattaagatatagcgcaaaacatatgcttaaaaagcatagatatctaaaaggatttagcaactatcttttttattttattgaaaagataaagcattaaaactgggaaactataaagtaatgatataagggtagcattgtggactcatttcctgccatagagatagataaagttaaagcctgggattttcggctagctaatataaatacttctgaatgtttaaatgttgcctatggtgtcgatgctaattatcttgatggtgtaggtgtttccatcacatcaattgtcctaaataatcgacatattaatcttgatttttatattattgctgatgtttataatgatggtttttttcaaaaaattgcaaagcttgcagagcaaaaccaattaagaatcacgttatatagaattaacactgataagctccagtgcttgccttgtacacaggtctggtcaagagcaatgtacttccgtttatttgcatttcaattattgggtttaacgcttgatcgtttgctttatcttgatgcagatgttgtttgtaaaggcgatattagccaactattacatctgggtttaaatggagcggttgctgctgttgttaaagatgttgagccaatgcaagaaaaggcggtatccaggttgtctgatcctgaattacttgggcagtactttaattccggtgtcgtttatttagacttaaaaaaatgggctgacgcaaaactaacagaaaaagcgttgtctattcttatgagtaaagataatgtttataaataccctgatcaggatgttatgaatgtcttactgaaagggatgacattatttttgcctcgtgagtacaatacaatttatacaattaaaagtgaattaaaagacaaaacacatcaaaactataaaaagctgattacagaaagtactcttcttattcattatacaggtgcaactaaaccgtggcacaaatgggcaatttatccatcggtaaaatactataaaatagctttagaaaattccccctggaaagatgactctccacgagatgcgaaatcaattattgaatttaaaaaagatataaacatcttttagtgcaacatcatt

SEQ ID NO: 48 - protein, 344 aa, Escherichia coli
MRYHGDMLLTTPVISTLKQNYPDAKIDMLLYQDTIPILSENPEINALYGISNKGAGTFDKIKNVLSLIKTLRANNYDLVINLTDQWMVALLVRCLPARMKISQLYGHRQHGIWKKSFTHLAPIHGTHIVERNLSVLEPLGITDFYTDTTMSYAEDCWKKMRRELDALGVKDHYVVIQPTARQIFKCWDNDKFSKVIDALQQRGYQVVLTCGPSADDLACVDEIARGCETKPITGLAGKTRFPELGALIDHAVLFIGVDSAPGHIAAAVKTPVISLFGATDHVFWRPWTENIIQFWAGNYQKMPTRHELDRNKKYLSVIPAEDVIAATEKLLPEDAPSADRNAQL

SEQ ID NO: 49 - protein, 371 aa, Escherichia coli
IVAFCLYKYFPFGGLQRDFMRIASTVAARGHHVRVYTQSWEGDCPKAFELIQVPVKSHTNHGRNAEYYAWVQNHLKEHPADRVVGFNKMPGLDVYFAADVCYAEKVAQEKGFLYRLTSRYRHYAAFERATFEQGKSTKLMMLTDKQIADFQKHYQTEPERFQILPPGIYPDRKYSEQIPNSREIYRQKNGIKEQQNLLLQVGSDFGRKGVDRSIEALASLPESLRHNTLLFVVGQDKPRKFEALAEKLGVRSNVHFFSGRNDVSELMAAADLLLHPAYQEAAGIVLLEAITAGLPVLTTAVCGYAHYIADANCGTVIAEPFSQEQLNEVLRKALTQSPLRMAWAENARHYADTQDLYSLPEKAADIITGGL

SEQ ID NO: 50 - protein, 265 aa, Escherichia coli
MVELKEPLATLWRGKDAFAEVKKLNGEVFRELETRRTLRFELSGKSYFLKWHKGTTLKEIIKNLLSLRMPVLGADREWHAIHRLSDVGVDTMKGIGFGEKGLNPLTRASFIITEDLTPTISLEDYCADWAVNPPDIRVKRMLIARVATMVRKMHTAGINHRDCYICHFLLHLPFTGREDELKISVIDLHRAQIRAKVPRRWRDKDLIGLYFSSMNIGLTQRDIWRFMKVYFGMPLRKILSLEQNLLNMASVKAERIKERTQRKGL

SEQ ID NO: 51 - protein, 311 aa, Escherichia coli
MTIYFINWVADYELKMIQYLKKKYKIKNITTPKKYNWINKKISKIGMDNAWLGRLFIKHYLNDIKKDDIIIINDSVVNKGINKQILKNINCHKVLLLRNTVGEDFILDNANYFDIIYDFEHRFIGNEKIKAIEQFFPIGMDEIRNYSLSDKNNSQPICFFLGRDKGRLQIINELAERLTTLGCKLDFNVVKDKTSSTTSKYLIEKQISYEENIRRTLNANIIVDITKENQSGWTLRILEALFFNKKLITNNINVFGSEIYSESRFFIIGHDDWDKLEYFINSSVKPMDYDSLYKFSPDKMMSTIVSDFIDK

SEQ ID NO: 52 - protein, 369 aa, Escherichia coli
VSFTQLMRVSMKIAFIGEAVSGFGGMETVIRDVITTFRQQHIQSEMFFFCRNDKMDKGWLEGIKYSCSFSNIRLGFLRRAKHIHALSKWLQEYQPDIVICIDVISCLFAAKARKKSGIDMPVFSWPHFSLDHKKHAEYITCADYHLAISSGIKQQMINRGVAESTINVIFNPVETKDSVIPAPEEGETATFIYVGRMKFEGQKRVKDLLDGLSQAKGNWKLHVLGDGSDFEKCQAYGRELNIDDRIVWYGWQQYPWELVQQDIEKVSALLLTSSFEGFPMTLLEALSWGIPCISADCVSGPADIIQPDVNGHLYQPGDIAGFVTLLNKYIAGEIHIEHEKIPASIDEFYQSKYYDRLHKVIISAISRRK

SEQ ID NO: 53 - protein, 339 aa, Escherichia coli
MQQVFFQETEFLNSVIDYDHKVETENLCLDIAYGTDKNFLFGCGISIASILKYNEGSRLCFHIFTDYFGDDDRKYFDALALQYKTRIKIYLINGDRLRSLPSTKNWTHAIYFRFVIADYFINKAPKVLYLDADIICQGTIEPLINFSFPDDKVAMVVTEGQADWWEKRAHSLGVAGIAKGYFNSGFLLINTAQWAAQQVSARAIAMLNEPEIIKKITHPDQDVLNMLLADKLIFADIKYNTQFSLNYQLKESFINPVTNDTIFIHYIGPTKPWHDWAWDYPVSQAFMEAKNASPWKNTALLKPNNSNQLRYSAKHMLKKHRYLKGFSNYLFYFIEKIKH

SEQ ID NO: 54 - protein, 314 aa, Escherichia coli
VDSFPAIEIDKVKAWDFRLANINTSECLNVAYGVDANYLDGVGVSITSIVLNNRHINLDFYIIADVYNDGFFQKIAKLAEQNQLRITLYRINTDKLQCLPCTQVWSRAMYFRLFAFQLLGLTLDRLLYLDADVVCKGDISQLLHLGLNGAVAAVVKDVEPMQEKAVSRLSDPELLGQYFNSGVVYLDLKKWADAKLTEKALSILMSKDNVYKYPDQDVMNVLLKGMTLFLPREYNTIYTIKSELKDKTHQNYKKLITESTLLIHYTGATKPWHKWAIYPSVKYYKIALENSPWKDDSPRDAKSIIEFKKDINIF

SEQ ID NO: 55 - DNA, 8391 bp, Mycobacterium bovis
  CDS (1)..(8391)
atgggtacgcgcactggcggccgaggacccggttccgtccgacaagcacctgacgtcggccgccgtgtcggtgcccggcgtgttgcttacccagatcgcggcgacccgggcgctggcccgtcaaggcatggacctcgtggccaccccgccggtcgccatggcgggcattcgcaaggtgtgctggcggtggaagccctcaaggctggtggggcacgcgacgtcgagctgtttgccttggcccagttgatcggtgccgccggaacgctggtggcccgccggcgcgaatttccgtcctgggcgatcgcgccgatggtatcggtcaccaacgccgaccccgagcgcatcggccggttgctcgacgagttcgcccaggacgtgcgcacggtgctgccaccggtgttgtccatccgcaacggccggcgtgccgtcgtcatcaccggcacccccgagcagctgtcgcgtttcgagctttattgccgccagatctccgagaaggaagaagccgaccgcaagaacaaggtccgcggcggcgacgtcttctcgccggtcttcgagccggtgcaggtggaggtgggctttcacaccccgcggctatccgacgggatcgacatcgtcgcgggctgggccgagaaggcgggcctcgatgtcgccttggctcgggagctggccgatgccatcttgatcagaaaggtcgactgggtcgacgagatcacccgtgtccaccgggccggcgcccgctggatcctcgacctggggccgggcgacatcctgacccgactgaccgcaccggtgatccgcggcctgggcatcggcatcgtgccggcgcgtacccgcggtggccagcgcaacctgttcaccgtcggcgccacccccgaggttgcccgggcctggtcgagctacgcaccgaccgtggttcgcctccccgacggcagggtcaagctctcgacgaagttcacccggctgacccgccgctcgccgatcctgctcgcgggcatgaccccgaccaccgtggacgccaagatcgtcgccgcggcggccaacggccggcactgggccgagctggcggcgcggggcaggtcaccgaagagatcttcggtaaccgcatcgaacaaatggccggcctgctcgagccgggccgcacctatcagttcaacgcgctgttcctcgatccctacctgtgaagcttcaggtgggcggcaagcggttggtgcagaaggcccgccagtccggcgccgcgatcgacggcgtggtgatcagcgccggcatcccagacctcgacgaggccgtcgagctgatcgacgaactgggcgacatcggcatcagccacgtcgtgttcaaacccgggaccatcgagcagatccgctcggtgattcgcatcgccaccgaggtgcccaccaagccggtgatcatgcacgtcgagggccgggcgcgccggcgggcaccattcctgggaggatctcacacctgctgctggctacctactcggcagatcgggcaccgcgccaacatcacgtgtgcgtcggcggcggccatctcggcaccccgaagaagggctgcggatatttgtccgggcctgggcgcagcgtacggcttcccattgatgccgatcgacgcatcctggtcggcaccgcggcgatggccaccaaggaatccaccacgtcgccatcggtcaagcggatgctcgtcgacactcagggcaccgaccaatggatcagcgccggaaaagcgcagggccgcatgcctccagccgagtcagctcggtgccgacatccacgagatcgacacagcgcatccgtgcggcgctgctcgacgaggtggccggtgacgcggaggcggtcgcggagcgtcgcatggccaagaccgccaagccctacttgccgacgtcgccgacatgacctacctgcagtggctgcgggcgctacgtcgaactggccatcggggaaggcaactcgaccgccgacaccgcctcggtgggcagcccgtggctggccgacactggcgggaccgcttcgagcagatgctgcagcgtgccgaagcccggttgcacccacaggatttcggcccgatccagacgctattcaccgatgctggcctgctggacaatccgcagcagcgatcgccgccctcgtggcgcgctaccccgacgccgagaccgtgcagttgcatcccgcggatgtgccctttttcgtgacgttgtgcaagacgctgggcaagccggtcaacttcgtgccggcgatcgacctcgtcgtgcgcgctggtggcgcagcgactcgctgtggcaggcccacgacgcccgctacgacgccgatgcggtgtgcatcattccgggcacgcgtcggtagccgcatcacccggatggatgaacccgtcggtgagttgctggacgctttcgagcaagccgcaatcgatgaagtgctcggcgccggtgtcgagccgaaggatgtcgcgtccggccggctgggccgggccgacgtggccggaccgttggctgtcgtcctcgacgcacccgatgtgcgctgggccggtcgcaccgtgaccaacccggtgcatcggatccgcgacccggccgaatggcaggtgcacgatggacccgaaaacccgcgcgccgcacactcatccaccggcgcccggctgcagacgcacggcgacgacgtcgccttgagcgtcgcgcgtctcgggcacctgggtcgacatccgattcacgttgccggccaacaccgtcgatggcggcaccccggtgatcgccaccgaggacgccaccacgccatgcgcacggtgctgcgatcgccgccggtgtcgacagcccggagttcttgctgcggtggccaacgggacggccactttgacggtggactggcaccccgagcgtgttgccgaccacaccgtcaccgccacgttcggtgcgcgctggcacccagcctcaccaacgtgccgacgcgactcgtcggcccttgttggccagcggttttcgcggccatcggatcggcggtcaccgacaccggtgagccggtggtggaaggcctgctgagcctggtgcatctggacacgcggccgcgcgtggtcggtcagctgcccacggtcccggcccaattgaccgtcacgcaacggctgccaacgcaaccgatacggacatgggccgcgtcgtgccggtctcggtcgtcgttcaccgcatggcgccgtgatcgccactctcgaggagcgattcgcgatcctgggtcgcaccggttcgccgagctggaccggcgcgagccggtggcgcggtgtcgcgaacgccaccgacaccccgcgcgtcgccgccgcgacgtcacgatcaccgcgccggtcgacatgcgcccgttcgcggtggtgtccggcgaccacaaccccattcacaccgaccgggccgccgctgcttgccggcctggagtcgccgatcgtgcacggcatgtggctgtcggccgcggcgcaacacgcggtgaccggcaccgacgggcaggcccgccaccggcccggctggtcggctggaccgcgcggtttttgggcatggtggccccggcgacgaggtggacttccggtcgagcgcgtcggatcgaccagggcgcagagattgtggacgtggccgcgcgcgtcgggtcggatctagtgatgtcggcctccgcgcgactggccgcacccaagacggtctacgcattccccggccagggcatccaacacaagggcatgggcatggaggtgcgcgccgctccaaggcggcccgcaaggtgtgggacaccgcggacaagttcacccgcgacaccctgggcttctcggtactgcacgtggtccgcgacaacccgaccagcatcatcgccagcggtgtgcactaccaccaccgacggggtgctctacctgacgcagttcacccaggtcgcgatggcgacggtggcggccgggcaggtcgccgagatgcgtgaacagggagccttcgtcgaaggcgccatcgcgtgcggccactcggtcggcgagtacaccgcgctggcctgcgtgaccggcatctaccaactggaagccttgctggagatggtgtttcaccgcgggtcgaagatgcacgacatcgttccgcgcgacgagctcggccgctccaactatcggctgtcggccatccggccgtcccagatcgacctcgacgacgccgacgtgcccgcgttcgtcgccgggatcgcggagagcaccggtgaattcctggagatcgagaatttcaacctcggtggctcgcaatacgcgatcgcgggcacggtacgcggcctcgaggcgctcgaggccgaggtggagcggcgccgcgagctcaccggcggccgacggtcgttcattttggtgcccggcatcgatgttccgttccactcgcgagtgctgcgggtcggggtggccgaattccggcgctcgctggaccgggtcatgcggccgacgcggacccgacctgatcatcgggcgctacattcccaacctggtgccgcggaagttcaaccctggaccgcgacttcatccaggaaatccgggatttggtgccccgccgagccgctcgacgagatcctcgccgactacgacacctggcttcgcgacgaccggcgagatggcgcgcacggtgttcatcgagctgctggcatggcaattcgccagcccggtgcgctggatcgagacgcaggatctgctgttcatcgaggaggcgccggcgggctgggtgtggagcgattcgtcgagatcggtgtgaagagctcaccgacggtggcggggtcttgccaccaacaccctcaaactgcccgaatacgcccacagcacagtgaagtgctcaacgccgagcgtgatgcgcggtgctgttcgccaccgacaccgacccggagccggagccggaggaagacgagccggtcgcggaatcgcccgcgccggacgtcgtctcggaagccgcccccgtcgcgccggccgcttcgtcggcgggcccgcgtcccgacgatctggttttcgacgccgccgatgccacgctgcgtgatcgcgctctcggccaagatgcgcatcgaccagatcgaagaactcgactccatcgagtccatcaccgacggtgcgtcgtcgcggcgcaaccagctgctggtggacctgggctccgagctgaacctcggtgccattgaacggcgccgccgaatcggacctggccggtctgcgctcacaggtgaccaaactggcgcgcacctacaacgttacggcccagtgctttccgacgccatcaacgaccacgttcgcaccgtcctcggaccgtcgggcaagcggcccggcgccatcgccgagcgggtgaagaagacctgggagctcggtgaggctgggccaagcatgtcaccgtcgaggtcgcgctgggcacccgcgagggcagcagcgttcgcggcggcgccatgggccacctgcacgagggcgcgctggccgatgccgcctccgtcgacaaggtcatcgacgcggcggtcgcatcggtggccgcggccagggcgtttcggtagcgctgcgtcggccggtagtggcggcgccaccatcgacgcggccgcgctcagcgagttcaccgaccaaatcaccggccgtgagggcgtgctgcctccgcggcccgcctggtgctggggcagctgggactggacgaccccatcaaccgttgccggccgccccgattccgagctgatcgacttggtcaccgccgaactgggacggactggccgcggttggtggcaccggtgttcgaccccaagaaggccgtcgtattcgacgaccgctggccagcgcccgcgaggacctggtgaagctgtggctgaccgacggaaggaccgaaggcgacatcgacgccgactggccgcgctggcggagcgcttcgagggtgccgccacgtcgtggcgacccaggctacctggtggcaaggtaagtcgctcgcgcgggccggcagatccatgcatcgctgtacggccgcatgccgccggcgccgagaaccccgaaccccgcgtacggcggcgaagttgccgtggtgaccggcgcttcgaagggttcgatcgccgcgtcggtggtggctcggctgctcgacgcggagccaccgtcatcgcgaccacctccaagctcgacgaggagcggctgcggttctaccgcacgctgtatcgcgaccacgcccgttacggcgcggcgctgtggctggtcgcggcgaacatggcgtcctactccgacgtcgacgccctggtcgaatggatcggcaccgaacagaccgaaagccttgggccgcagtcgattcacatcaaagacgcgcagaccccgacgctgctgttccgttcgcggcgcacgcgtgtcgggactgtcggaggccggttcgcgcgccgagatggagatgaaagtgctgctgtggcggtgcaacggctgatcggcggcctgtcgacgatcggcgccgaacgcgacatgccgtcgcggctcgagcgtggtgctgcccggctcgcccaaccgtggcatgttcggcggcgacgggccctacggcgaagccaagtccgcgctggatgccgtggtgacgcgctggcacgccgagtcgtcctgggcggcacgggtcagcctggcgcacgcgctcatcggctggacccgcggcaccgggctgatgggccacaacgatgccatcgtggccgccgtcgaagaggccggggtcaccacctactcgaccgacgagatggcgcggctgctgctcgacctgtgtcatgcggaatccaaggtggctgcggccgttcgccgatcaaggccgacctgaccgggggcctgccgaggccaacctcgacatggccgagctggcggccaaggcgcgcgagcagatgtcggcagcggcggccgtcgacgaggacgccgaggcccctggcgccatcgccgcgctgccgtcgccgccccggtttcacccccgcaccgccgccgcaatgggacgacctcgatgtcgacccggccgacctggtggtgatcgtcggcggccgcgaaatcggcccgtacggctcgtcacgcacccggttcgagatggaggtcgaaaacgagctgtcggcggccggcgtgctggagctggcctggaccactgggttgatcgctgggagacgacccgcaacccggttggtacgacaccgaatccggcgaaatggtcgacgaatccgagttggtgcagcgctacacgacgccgtggtgcagcgcgtcggcattcgcgaattcgttgatgacggcgcgatcgaccccgaccacgcctcgccgctgctggtgtcggtgttcctggagaaggacttcgcgttcgtggtgtcctcggaggccgatgcgcgcgccttcgtcgagttcgatcccgagcacacggtcatccggccggtgcccgactccaccgactggcaggtcatccgcaaggccggcaccgagatccgggtgccgcgaaagaccaagctgtcccgcgtcgtcggcggccagatcccgaccgggttcgacccgacggtgtggggcatcagcgcagacatggccggttccatcgaccggttggcggtatggaacatgtggcggaccgtcgaccggttcctgtcgtccggtttcagcccggccgaggtgatgcgttacgtgcacccgagtttggtggccaacacccagggcaccggcatgggcggcggcacgtcgatgcagacgatgtaccacggcaatctgttgggccgcaacaagccgaacgacatcttccaggaagtcttgccgatatcattcgccgcgcacgtggttcagtcctacgtcggtagctacggtgcgatgatccacccggtagccgcgtgcgccaccgccgcggtgtcggtcgaggaaggtgtcgacaagatccggttgggaaggctcaactggtggtcggcggccgtggatgacctgacgctggagggcatcatcggattcggtgacatggccgccaccgccgacacgtccatgatgcgcggccgcggcatccacgactcgaagttttcccggcccaacgaccgccgccgtctggcttcgtcgaagcccaaggcggcgggacgatcctgttgggcgcggggacctggcgctgcggatggggctgccggtgctggcggtggtgggttcgcgcagtcgttcggcgacggcgtgcacacctcgatccgccccgggcctgggcgcgctgggggcggcgcgcggcggcaaggattcagctgcggcgggcgctggccaagctgcgtggccgccgacgacgtggcggtcatctccaagcacgacacctcgacgctggccaacgatcccaacgagaccgagttgcatgaacggctcgccgacgccctgggccgttccgagggcgccccgctgttcgtggtgtcgcagaagagcctgaccggccagccaagggcggcgcggcggtcttccagatga

SEQ ID NO: 56 - protein, 2796 aa, Mycobacterium bovis
MGTRTGGRGPGSVRQAPDVGRRVGARRVAYPDRGDPGAGPSRHGPRGHPAGRHGGHSQGVLAVEALKAGGARDVELFALAQLIGAAGTLVARRREFPSWAIAPMVSVTNADPERIGRLLDEFAQDVRTVLPPVLSIRNGRRAVVITGTPEQLSRFELYCRQISEKEEADRKNKVRGGDVFSPVFEPVQVEVGFHTPRLSDGIDIVAGWAEKAGLDVALARELADAILIRKVDWVDEITRVHRAGARWILDLGPGDILTRLTAPVIRGLGIGIVPARTRGGQRNLFTVGATPEVARAWSSYAPTVVRLPDGRVKLSTKFTRLTRRSPILLAGMTPTTVDAKIVAAAANGRHWAELAARGRSPKRSSVTASNKWPACSSRAAPISSTRCSSIPTCEASGGRQAVGAEGPPVRRRDRRRGDQRRHPRPRRGRRADRRTGRHRHQPRRVQTRDHRADPLGDSHRHRGAHQAGDHARRGPGAPAGTIPGRISHLLLATYSADRAPRQHHVCVGGGHLGTPKKGCGYLSGPGRSVRLPIDADRRILVGTAAMATKESTTSPSVKRMLVDTQGTDQWISAGKAQGRMPPAESARCRHPRDRHSASVRRCSTRWPVTRRRSRSVAWPRPPSPTCRRRRHDLPAVAAGATSNWPSGKATRPPTPPRWAARGWPTLAGPLRADAAACRSPVAPTGFRPDPDAIHRCWPAGQSAAAIAALVARYPDAETVQLHPADVPFFVTLCKTLGKPVNFVPAIDLVVRAGGAATRCGRPTTPATTPMRCASFRARVGSRITRMDEPVGELLDAFEQAAIDEVLGAGVEPKDVASGRLGRADVAGPLAVVLDAPDVRWAGRTVTNPVHRIRDPAEWQVHDGPENPRAAHSSTGARLQTHGDDVALSVARLGHLGRHPIHVAGQHRRWRHPGDRHRGRHHAMRTVLRSPPVSTARSSCCGGQRDGHFDGGLAPRACCRPHRHRHVRCALAPSLTNVPTRLVGPCWPAVFAAIGSAVTDTGEPVVEGLLSLVHLDTRPRVVGQLPTVPAQLTVTQRLPTQPIRTWAASCRSRSSFTAWRRDRHSRGAIRDPGSHRFAELDRREPVARCRERHRHPARRRRDVTITAPVDMRPFAVVSGDHNPIHTDRAAAACRPGVADRARHVAVGRGATRGDRHRRAGPPPARLVGWTARFLGMVAPATRWTSGRARRIDQGAEIVDVAARVGSDLVMSASARLAAPKTVYAFPGQGIQHKGMGMEVRAAPRRPARCGTPRTSSPATPWASRYCTWSATTRPASSPAVCTTTTDGVLYLTQFTQVAMATVAAGQVAEMREQGAFVEGAIACGHSVGEYTALACVTGIYQLEALLEMVFHRGSKMHDIVPRDELGRSNYRLSAIRPSQIDLDDADVPAFVAGIAESTGEFLEIENFNLGGSQYAIAGTVRGLEALEAEVERRRELTGGRRSFILVPGIDVPFHSRVLRVGVAEFRRSLDRVMRPTRTRPDHRALHSQPGAAEVQPWTATSSRKSGIWCPAEPLDEILADYDTWLRDDRRDGAHGVHRAAGMAIRQPGALDRDAGSAVHRGGAGGLGVERFVEIGVKSSPTVAGSCHQHPQTARIRPQHSEVLNAERDARCCSPPTPTRSRSRRKTSRSRNRPRRTSSRKPPPSRRPLRRRARVPTIWFSTPPMPRCVIALSAKMRIDQIEELDSIESITDGASSRRNQLLVDLGSELNLGAIERRRRIGPGRSALTGDQTGAHLQRYGPVLSDAINDHVRTVLGPSGKRPGAIAERVKKTWELGEAGPSMSPSRSRWAPARAAAFAAAPWATCTRARWPMPPPSTRSSTRRSHRWPRPGRFGSAASAGSGGATIDAAALSEFTDQITGREGVLPPRPAWCWGSWDWTTPSTVAGRPDSELIDLVTAELGRTGRGWWHRCSTPRRPSYSTTAGQRPRGPGEAVADRRKDRRRHRRRLAALAERFEGAATSWRPRLPGGKVSRSRGPADPCIAVRPHAAGAENPEPRVRRRSCRGDRRFEGFDRRVGGGSAARRGATVIATTSKLDEERLRFYRTLYRDHARYGAALWLVAANMASYSDVDALVEWIGTEQTESLGPQSIHIKDAQTPTLLFRSRRTRVGTVGGRFARRDGDESAAVAVQRLIGGLSTIGAERDMPSRLERGAARLAQPWHVRRRRALRRSQVRAGCRGDALARRVVLGGTGQPGARAHRLDPRHRADGPQRCHRGRRRRGRGHHLLDRRDGAAAARPVSCGIQGGCGRSPIKADLTGGLPRPTSTWPSWRPRRASRCRQRRPSTRTPRPLAPSPRCRRRPGFTPAPPPQWDDLDVDPADLVVIVGGREIGPYGSSRTRFEMEVENELSAAGVLELAWTTGLIAGRRPATRLVRHRIRRNGRRIRVGAALHDAVVQRVGIREFVDDGAIDPDHASPLLVSVFLEKDFAFVVSSEADARAFVEFDPEHTVIRPVPDSTDWQVIRKAGTEIRVPRKTKLSRVVGGQIPTGFDPTVWGISADMAGSIDRLAVWNMWRTVDRFLSSGFSPAEVMRYVHPSLVANTQGTGMGGGTSMQTMYHGNLLGRNKPNDIFQEVLPISFAAHVVQSYVGSYGAMIHPVAACATAAVSVEEGVDKIRLGRLNWWSAAVDDLTLEGIIGFGDMAATADTSMMRGRGIHDSKFSRPNDRRRLASSKPKAAGRSCWARGPGAADGAAGAGGGGFAQSFGDGVHTSIRPGPGRAGGGARRQGFSCGGRWPSCVAADDVAVISKHDTSTLANDPNETELHERLADALGRSEGAPLFVVSQKSLTGQPRAARRSSR

SEQ ID NO: 57 - DNA, 192 bp, Homo sapiens
  CDS (1)..(192)
gatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctggggtaagggc

SEQ ID NO: 58 - protein, 64 aa, Homo sapiens
DLAARNCLVGENHLVKVADFGLSRLMTGDTYTAHAGAKFPIKWTAPESLAYNKFSIKSDVWGKG

SEQ ID NO: 59 - DNA, 3955 bp, Rattus norvegicus
  CDS (17)..(3799)
ccgggccggagccgcaatgatcatcatggagctggcggcctggtgccgctgggggttcctcctcgccctcctgccccccggaatcgcgggcacccaagtgtgtaccggcacagacatgaagttgcggctccctgccagtcctgagacccacctggacatgctccgccacctgtaccagggctgtcaggtagtgcagggcaacttggagcttacctacgtgcctgccaatgccagcctctcattcctgcaggacatccaggaagttcagggttacatgctcatcgctcacaaccaggtgaagcgcgtcccactgcaaaggctgcgcatcgtgagagggacccagctctttgaggacaagtatgccctggctgtgctagacaaccgagatcctcaggacaatgtcgccgcctccaccccaggcagaaccccagaggggctgcgggagctgcagcttcgaagtctcacagagatcctgaagggaggagttttgatccgtgggaaccctcagctctgctaccaggacatggttttgtggaaggacgtcttccgcaagaataaccaactggctcctgtcgatatagacaccaatcgttcccgggcctgtccaccttgtgcccccgcctgcaaagacaatcactgttggggtgagagtccggaagactgtcagatcttgactggcaccatctgtaccagtggttgtgcccggtgcaagggccggctgcccactgactgctgccatgagcagtgtgccgcaggctgcacgggccccaagcattctgactgcctggcctgcctccacttcaatcatagtggtatctgtgagctgcactgcccagccctcgtcacctacaacacagacacctttgagtccatgcacaaccctgagggtcgctacacctttggtgccagctgcgtgaccacctgcccctacaactacctgtctacggaagtgggatcctgcactctggtgtgtcccccgaataaccaagaggtcacagctgaggacggaacacagcgttgtgagaaatgcagcaagccctgtgctcgagtgtgctatggtctgggcatggagcaccttcgaggggcgagggccatcaccagtgacaatgtccaggagtttgatggctgcaagaagatctttgggagcctggcatttttgccggagagctttgatggggacccctcctccggcattgctccgctgaggcctgagcagctccaagtgttcgaaaccctggaggagatcacaggttacctgtacatctcagcatggccagacagtctccgtgacctcagtgtcttccagaaccttcgaatcattcggggacggattctccacgatggcgcgtactcattgacactgcaaggcctggggatccactcgctggggctgcgctcactgcgggagctgggcagtggattggctctgattcaccgcaacgcccatctctgctttgtacacactgtaccttgggaccagctcttccggaacccacatcaggccctgctccacagtgggaaccggccggaagaggacttgtgcgtctcgagcggcttggtctgtaactcactgtgtgcccacgggcactgctgggggccagggcccacccagtgtgtcaactgcagtcatttccttcggggccaggagtgtgtggaggagtgccgagtatggaaggggctcccccgggagtatgtgagtgacaagcgctgtctgccgtgtcaccccgagtgtcagcctcaaaacagctcagagacctgctttggatcggaggctgatcagtgtgcagcctgcgcccactacaaggactcgtcctcctgtgtggctcgctgccccagtggtgtgaaaccggacctctcctacatgcccatctggaagtacccggatgaggagggcatatgccagccgtgccccatcaactgcacccactcctgtgtggatctggatgaacgaggctgcccagcagagcagagagccagcccggtgacattcatcattgcaactgtagagggcgtcctgctgttcctgatcttagtggtggtcgttggaatcctaatcaaacgaaggagacagaagatccggaagtatacgatgcgtaggctgctgcaggaaactgagttagtggagccgctgacgcccagcggagcaatgcccaaccaggctcagatgcggatcctaaaagagacggagctaaggaaggtgaaggtgcttggatcaggagcttttggcactgtctacaagggcatctggatcccagatggggagaatgtgaaaatccccgtggctatcaaggtgttgagagaaaacacatctcctaaagccaacaaagaaattctagatgaagcgtatgtgatggctggtgtgggttctccgtatgtgtcccgcctcctgggcatctgcctgacatccacagtacagctggtgacacagcttatgccctacggctgccttctggaccatgtccgagaacaccgaggtcgcctaggctcccaggacctgctcaactggtgtgttcagattgccaaggggatgagctacctggaggacgtgcggcttgtacacagggacctggctgcccggaatgtgctagtcaagagtcccaaccacgtcaagattacagatttcgggctggctcggctgctggacattgatgagacagagtaccatgcagatgggggcaaggtgcccatcaaatggatggcattggaatctattctcagacgccggttcacccatcagagtgatgtgtggagctatggagtgactgtgtgggagctgatgacttttggggccaaaccttacgatggaatcccagcccgggagatccctgatttgctggagaagggagaacgcctacctcagcctccaatctgcaccattgatgtctacatgattatggtcaaatgttggatgattgactctgaatgtcgcccgagattccgggagttggtgtcagaattttcacgtatggcgagggacccccagcgttttgtggtcatccagaacgaggacttgggcccatccagccccatggacagtaccttctaccgttcactgctggaagatgatgacatgggtgacctggtagacgctgaagagtatctggtgccccagcagggattcttctccccggaccctaccccaggcactgggagcacagcccatagaaggcaccgcagctcgtccaccaggagtggaggtggtgagctgacactgggcctggagccctcggaagaagggccccccagatctccactggctccctcggaaggggctggctccgatgtgtttgatggtgacctggcaatgggggtaaccaaagggctgcagagcctctctccacatgacctcagccctctacagcggtacagcgaggaccccacattacctctgccccccgagactgatggctatgttgctcccctggcctgcagcccccagcccgagtatgtgaaccaatcagaggttcagcctcagcctcctttaaccccagagggtcctctgcctcctgtccggcctgctggtgctactctagaaagacccaagactctctctcctgggaagaatggggttgtcaaagacgtttttgccttcgggggtgctgtggagaaccctgaatacttagtaccgagagaaggcactgcctctccgccccacccttctcctgccttcagcccagcctttgacaacctctattactgggaccagaactcatcggagcaggggcctccaccaagtaactttgaagggacccccactgcagagaaccctgagtacctaggcctggatgtacctgtatgagacgtgtgcagacgtcctgtgctttcagagtggggaaggcctgacttgtggtctccatcgccacaaagcagggagagggtcctctggccacattacatccagggcagacggctctaccaggaacctgccccgaggaacctttccttgctgcttgaa

SEQ ID NO: 60 - protein, 1260 aa, Rattus norvegicus
MIIMELAAWCRWGFLLALLPPGIAGTQVCTGTDMKLRLPASPETHLDMLRHLYQGCQVVQGNLELTYVPANASLSFLQDIQEVQGYMLIAHNQVKRVPLQRLRIVRGTQLFEDKYALAVLDNRDPQDNVAASTPGRTPEGLRELQLRSLTEILKGGVLIRGNPQLCYQDMVLWKDVFRKNNQLAPVDIDTNRSRACPPCAPACKDNHCWGESPEDCQILTGTICTSGCARCKGRLPTDCCHEQCAAGCTGPKHSDCLACLHFNHSGICELHCPALVTYNTDTFESMHNPEGRYTFGASCVTTCPYNYLSTEVGSCTLVCPPNNQEVTAEDGTQRCEKCSKPCARVCYGLGMEHLRGARAITSDNVQEFDGCKKIFGSLAFLPESFDGDPSSGIAPLRPEQLQVFETLEEITGYLYISAWPDSLRDLSVFQNLRIIRGRILHDGAYSLTLQGLGIHSLGLRSLRELGSGLALIHRNAHLCFVHTVPWDQLFRNPHQALLHSGNRPEEDLCVSSGLVCNSLCAHGHCWGPGPTQCVNCSHFLRGQECVEECRVWKGLPREYVSDKRCLPCHPECQPQNSSETCFGSEADQCAACAHYKDSSSCVARCPSGVKPDLSYMPIWKYPDEEGICQPCPINCTHSCVDLDERGCPAEQRASPVTFIIATVEGVLLFLILVVVVGILIKRRRQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVREHRGRLGSQDLLNWCVQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPSSPMDSTFYRSLLEDDDMGDLVDAEEYLVPQQGFFSPDPTPGTGSTAHRRHRSSSTRSGGGELTLGLEPSEEGPPRSPLAPSEGAGSDVFDGDLAMGVTKGLQSLSPHDLSPLQRYSEDPTLPLPPETDGYVAPLACSPQPEYVNQSEVQPQPPLTPEGPLPPVRPAGATLERPKTLSPGKNGVVKDVFAFGGAVENPEYLVPREGTASPPHPSPAFSPAFDNLYYWDQNSSEQGPPPSNFEGTPTAENPEYLGLDVPV

SEQ ID NO: 61 - DNA, 4989 bp, Homo sapiens
  CDS (46)..(4149)
ttttttttttttttgagaaagggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggaggcaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagttctgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggc

SEQ ID NO: 62 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 63 - DNA, 640 bp, Homo sapiens
  CDS (17)..(592)
tcgggcctccgaaaccatgaactttctgctgtcttgggtgcattggagccttgccttgctgctctacctccaccatgccaagtggtcccaggctgcacccatggcagaaggaggggggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatct

SEQ ID NO: 64 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 65 - DNA, 3690 bp, Mus musculus
  CDS (256)..(3690)
ctggaggggtataaatacctgatggctgctgccagggtcacaactttacagggagttgaagactgagactctggccccacgggacacagtgtcactggtttgaaacttctcagccaccttggtgaagggactgagctgttagagacacttctgaggctcctcacgcttgggtcttgttcactccacggagtagcctagtcaactgcaagagaacggagaacgttggatttggagcagaagtgcaaagtctcagacatggcttgcccctggaagtttctcttcaaagtcaaatcctaccaaagtgacctgaaagaggaaaaggacattaacaacaacgtgaagaaaaccccttgtgctgttctcagcccaacaatacaagatgaccctaagagtcaccaaaatggctccccgcagctcctcactgggacagcacagaatgttccagaatccctggacaagctgcatgtgacatcgacccgtccacagtatgtgaggatcaaaaactggggcagtggagagattttgcatgacactcttcaccacaaggccacatcggatttcacttgcaagtccaagtcttgcttggggtccatcatgaaccccaagagtttgaccagaggacccagagacaagcctacccctctggaggagctcctgcctcatgccattgagttcatcaaccagtattatggctcctttaaagaggcaaaaatagaggaacatctggccaggctggaagctgtaacaaaggaaatagaaacaacaggaacctaccagctcactctggatgagctcatctttgccaccaagatggcctggaggaatgcccctcgctgcatcggcaggatccagtggtccaacctgcaggtctttgacgctcggaactgtagcacagcacaggaaatgtttcagcacatctgcagacacatactttatgccaccaacaatggcaacatcaggtcggccatcactgtgttcccccagcggagtgacggcaaacatgacttcaggctctggaattcacagctcatccggtacgctggctaccagatgcccgatggcaccatcagaggggatgctgccaccttggagttcacccagttgtgcatcgacctaggctggaagccccgctatggccgctttgatgtgctgcctctggtcttgcaagctgatggtcaagatccagaggtctttgaaatccctcctgatcttgtgttggaggtgaccatggagcatcccaagtacgagtggttccaggagctcgggttgaagtggtatgcactgcctgccgtggccaacatgctactggaggtgggtggcctcgaattcccagcctgccccttcaatggttggtacatgggcaccgagattggagttcgagacttctgtgacacacagcgctacaacatcctggaggaagtgggccgaaggatgggcctggagacccacacactggcctccctctggaaagaccgggctgtcacggagatcaatgtggctgtgctccatagtttccagaagcagaatgtgaccatcatggaccaccacacagcctcagagtccttcatgaagcacatgcagaatgagtaccgggcccgtggaggctgcccggcagactggatttggctggtccctccagtgtctgggagcatcacccctgtgttccaccaggagatgttgaactatgtcctatctccattctactactaccagatcgagccctggaagacccacatctggcagaatgagaagctgaggcccaggaggagagagatccgatttagagtcttggtgaaagtggtgttctttgcttccatgctaatgcgaaaggtcatggcttcacgggtcagagccacagtcctctttgctactgagacagggaagtctgaagcactagccagggacctggccaccttgttcagctacgccttcaacaccaaggttgtctgcatggaccagtataaggcaagcaccttggaagaggagcaactactgctggtggtgacaagcacatttgggaatggagactgtcccagcaatgggcagactctgaagaaatctctgttcatgcttagagaactcaaccacaccttcaggtatgctgtgtttggccttggctccagcatgtaccctcagttctgcgcctttgctcatgacatcgaccagaagctgtcccacctgggagcctctcagcttgccccaacaggagaaggggacgaactcagtgggcaggaggatgccttccgcagctgggctgtacaaaccttccgggcagcctgtgagacctttgatgtccgaagcaaacatcacattcagatcccgaaacgcttcacttccaatgcaacatgggagccacagcaatataggctcatccagagcccggagcctttagacctcaacagagccctcagcagcatccatgcaaagaacgtgtttaccatgaggctgaaatcccagcagaatctgcagagtgaaaagtccagccgcaccaccctcctcgttcagctcaccttcgagggcagccgagggcccagctacctgcctggggaacacctggggatcttcccaggcaaccagaccgccctggtgcagggaatcttggagcgagttgtggattgtcctacaccacaccaaactgtgtgcctggaggttctggatgagagcggcagctactgggtcaaagacaagaggctgcccccctgctcactcagccaagccctcacctacttcctggacattacgacccctcccacccagctgcagctccacaagctggctcgctttgccacggacgagacggataggcagagattggaggccttgtgtcagccctcagagtacaatgactggaagttcagcaacaaccccacgttcctggaggtgcttgaagagttcccttccttgcatgtgcccgctgccttcctgctgtcgcagctccctatcttgaagccccgctactactccatcagctcctcccaggaccacaccccctcggaggttcacctcactgtggccgtggtcacctaccgcacccgagatggtcagggtcccctgcaccatggtgtctgcagcacttggatcaggaacctgaagccccaggacccagtgccctgctttgtgcgaagtgtcagtggcttccagctccctgaggacccctcccagccttgcatcctcattgggcctggtacgggcattgctcccttccgaagtttctggcagcagcggctccatgactcccagcacaaagggctcaaaggaggccgcatgagcttggtgtttgggtgccggcacccggaggaggaccacctctatcaggaagaaatgcaggagatggtccgcaagagagtgctgttccaggtgcacacaggctactcccggctgcccggcaaacccaaggtctacgttcaggacatcctgcaaaagcagctggccaatgaggtactcagcgtgctccacggggagcagggccacctctacatttgcggagatgtgcgcatggctcgggatgtggctaccacattgaagaagctggtggccaccaagctgaacttgagcgaggagcaggtggaagactatttcttccagctcaagagccagaaacgttatcatgaagatatcttcggtgcagtcttttcctatggggcaaaaaagggcagcgccttggaggagcccaaagccacgaggctctga

SEQ ID NO: 66 - protein, 1144 aa, Mus musculus
MACPWKFLFKVKSYQSDLKEEKDINNNVKKTPCAVLSPTIQDDPKSHQNGSPQLLTGTAQNVPESLDKLHVTSTRPQYVRIKNWGSGEILHDTLHHKATSDFTCKSKSCLGSIMNPKSLTRGPRDKPTPLEELLPHAIEFINQYYGSFKEAKIEEHLARLEAVTKEIETTGTYQLTLDELIFATKMAWRNAPRCIGRIQWSNLQVFDARNCSTAQEMFQHICRHILYATNNGNIRSAITVFPQRSDGKHDFRLWNSQLIRYAGYQMPDGTIRGDAATLEFTQLCIDLGWKPRYGRFDVLPLVLQADGQDPEVFEIPPDLVLEVTMEHPKYEWFQELGLKWYALPAVANMLLEVGGLEFPACPFNGWYMGTEIGVRDFCDTQRYNILEEVGRRMGLETHTLASLWKDRAVTEINVAVLHSFQKQNVTIMDHHTASESFMKHMQNEYRARGGCPADWIWLVPPVSGSITPVFHQEMLNYVLSPFYYYQIEPWKTHIWQNEKLRPRRREIRFRVLVKVVFFASMLMRKVMASRVRATVLFATETGKSEALARDLATLFSYAFNTKVVCMDQYKASTLEEEQLLLVVTSTFGNGDCPSNGQTLKKSLFMLRELNHTFRYAVFGLGSSMYPQFCAFAHDIDQKLSHLGASQLAPTGEGDELSGQEDAFRSWAVQTFRAACETFDVRSKHHIQIPKRFTSNATWEPQQYRLIQSPEPLDLNRALSSIHAKNVFTMRLKSQQNLQSEKSSRTTLLVQLTFEGSRGPSYLPGEHLGIFPGNQTALVQGILERVVDCPTPHQTVCLEVLDESGSYWVKDKRLPPCSLSQALTYFLDITTPPTQLQLHKLARFATDETDRQRLEALCQPSEYNDWKFSNNPTFLEVLEEFPSLHVPAAFLLSQLPILKPRYYSISSSQDHTPSEVHLTVAVVTYRTRDGQGPLHHGVCSTWIRNLKPQDPVPCFVRSVSGFQLPEDPSQPCILIGPGTGIAPFRSFWQQRLHDSQHKGLKGGRMSLVFGCRHPEEDHLYQEEMQEMVRKRVLFQVHTGYSRLPGKPKVYVQDILQKQLANEVLSVLHGEQGHLYICGDVRMARDVATTLKKLVATKLNLSEEQVEDYFFQLKSQKRYHEDIFGAVFSYGAKKGSALEEPKATRL

SEQ ID NO: 67 - DNA, 10422 bp, Homo sapiens
  CDS (6667)..(10176)
ctgggattgggacacactttctgggcactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagtgcatcctgcctgggagcaagttttccagggcagctttgagaagtcttggagaaacaaacctactaaacctgacagacagtaatactatttgcacaatgcttttctgtgggaaaggtagagccttttcactacgtattgagtacatagagtgtgagggttgacctggaacggctatcctcctggatgacgtgcgttttctgaagaactacatgttcgttgcaactcccacattagaatatgaagtcctaccgagagagatacggagactagacagatacagatgcatttgcatgtgaatacacaatcccacaatacagacgtcaaaacccataccagttattccagagagatggattgggcagaaggcagaaggagaatactctgatcgtttttcggccacgtgtgtgtgttatctcagtgtttctaagaagcgtttgctactttagattttttatttaaaaaaaatagtaataatctattaagtatgagagatgtgcagagaggattagtgatcgagagccatttttgctggtggcaatcatatggtacttttaatgggaatattagaaaggcaccggtaatgaccttgttgcagcacaaaggagagagtgtggggtgcccctgcatgttgtcccacctcttgtgacgtgtatcgttttagaatttccagtggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaaggtaaggagtctgtggccagacatctacacgcttcgatgctgggatgaaaagccatggaaattcccactgatgcagccgccttcaatggtaaacggatgctcgagtgttgcctgagttctaccatgtaggaggaagcctccgtgcactctctgggggagccagcggagtgatttctggtgcaacgtggttgggctttgtctttaggatgggcacaaaccctccagggggatcgacttcaaaattcaccttgttgtaaaacgggctacctcagtgtcccagccaaaatttttattgtaacatgctgtcaggtgtgtcactctttccaagccagtaagcttttccggggatttcttcaagtagccagcattcagagcaatcttcagcattgcagattctgagaaatgtggctctggagcctgtcaccctcgagaaacctaagagggctgcattgattccatgtggccctgggtctatggagcagtacatgagctcccagtgctctaaggctcttcagccctaggctttgaagggagtgatttctcagtattcttaaacctctttctgatgacacttgtacctgtgaggggtctagagagaaagagtagtagactcctactttactacaattcaggatgcagggcatgagaggattccctctctcctccaagggaagaagcttttggcgtgcacacatccctgagaagcaaagtgtctttgtcttcagtcagatacataggaccgttttctgccccatggcccggaagccaaaggccttggctttcatgatcaacggtctagggaaacatgcaaaatttccatgtctgtcccaaactctgcccccgacagccaattaccacctgcagcccgcattgccaaatgcggtgccgtttgcatgaagattcagtagagtttcctagaaaggtgctacctcgtgagctcactttccaatgaggaatctgatctggtgtgtttctctaaggtgtcaggtgaaatatttccaagaacttactacagttctagaatgggaggaatctgctgctttggtgtttgtttgttggtcggttttctcacatccatctgcctatggataaggaaaagagaacggtcgtaattctcatagactcctttctggttgtgtcacaaatggcttcacatgtttctctatgctcagagatactcagcttgatttcccgtgttttcatttcagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgcgtatgtctttgttctttaccataagagaagaaagggccaagtgaagtttctgttacaagagatgtgtctcaagctgagttctccgaactcaacttgtgacagatgcagatggcgtagcaaaatgtctcaggatgattgccttggagctaagggtctgagagaagggaaatgttaagctccctctccttcctcctacttctattgagcagaagggaaatctggaggtgaggagatcaccttctgaagaaagtcagaatgacaaaggaccagacacttagattacccttccacaacaccaactaaacgtcaatggagactttccagtctggaacttccgttacttctggccttccaccttccctgaagggaaggttgcgtttgccttttctctctgggttcaagaggaaagaataggtgcttatttatggacaggtgaattgatctgtttctatatctacgtatattccgattgtcagaaaaacactcgttcctaagtaccagtggcctgaagggatacaggttcccagcaagagaagatccaaggaaggaaggcagatgagagtcagcacagagagggatgctgaaaagtaaaagggatgggtggatggagagaagcccgggtctgaccacccaatggccaatattttggccacaagcgactaccagagacatggaaaaatggtttctacatgtgggacaacagatggtagaggacctagagaattgagagaggggcaatgatgggctccactccgcagatgccttggctttcttcctggatacccttcctgcactgaatagcaaggagatggagcccaagcagactgtagccatcttgctgaatggaggagagggattggagtttgggatgactgtggtagctgaaatttttctaggtctgctagaaataagaactggtttgtggaggaaaagagctctacaaatacgcatagaagtctcctccagtcgttggcctgacatgacgctgcctgtgcacaggaaatggttccacgagaaagtgtggcaaagaacatttactgagaaacagcaagtacaagagcacaggaagctcaataaagaagagagagatcacatagcactctgggatactggagttcttcccagctagaccagagagtcctcacggagcacattgccaattcagtggagaccccagaacagccgtaatttaaaggtacacttagtatattactagaataaagtcagctgcagacaaccccttgcacagctggaaagcaagtgtccaagcatcaaatcggtttccaatcaatgaagtgcctgtgagaggaaatctcaactctctttagaagtaaacaacaaagtcgattgcctcagctatgcggtatccgcagagtgagtcctaaatttaaaatctgactacatgtagaaaagcgtttcgtgtgacccatgaccaggaaataaatcgggtaatacaaacaggctcaggaatgagagaaatgattagaattgcgtgaaaatttgaaatatcagtatgataactgatttcaaatatttaaaaaaacaacatgcaagaaagcagatatcatatcaagagaaattaacagtacagaatagccaaattaaattaaagagctagtataaaaaaagtatgtcttaattgaaaaaaattactgtatggccggctgatcaatttagacgtttcagaggaaaacattacccaacacacaattctagagaacctacagaatgagctacacacacacacacacacacacacacaaactgaaaacacacccatactcacacacacgcagaaactcacaagttctaacacacacagacacgcgcacccctgaagaaacagtgaaatataaaattaagcgagcctcacagacatgtaggaaaatatgaaaagatttcctgcatgtgggaagcaagtcacagtaaagagcaagggagtttggaatagaaacaaataccagaatcaaggatggctgataacttttcaattacgaagaacattaaaaaaaatcacagaatcgtgaaactcaagggatcacatagggaatttcggaaaaaaaacccaacctgtatgatgtacttttgtacatcacagttcgaaggtaacaaggcaaagatataataagaagaaacctgtcacgagaaactggaggaaaaagagctgtgtcttcctacaagtacactgatacaaattgccaatgtgttcacctcagaaacactggaagccagataccagggaatattgttaaaatgataatcaggaacaaaaagagatcaaccgggaatgctgaatccagcaataaaatgccttgaagatcatccatgtcggataaatgcatattgtgcactgccccaaagaaagaaaccggaaactgtaagaattggaaatcagcaggcttatgtaacaagagaggtgacccgaaggaattaggtagaagaagaattaacaagaaaggaactttctgcagcccacgtaatgaagaatccagcaattggcaaatgtagatagatgtaaatgcaaaatattttcttgatcaaatttctatatctttgtaaatgagagttgactacttgaaacaaaatgatagcaagatatttaacttcagcatatgtagaggtaagaatttgaaatggtagcataaatcacgaagggattaattcgaagtgtaccgttgtaagtttctttacctcatgcacgatggtgtgtcatattaataaaagggtactgtgcgggttcgaagggatattgcaaatcctagagcaatcacaaaggtttgaactctgaggtttttggtataataagaatagtccatgcattcaaaagagggaagccaaggaagaactagaagtctttcaagagctcaggctcttatacatccagttgctcattgaaccagcttcctggaatggagggtctggggttgagactaggccacaagtctagagtctctagagagacagtgttggaaccccatggcccataatacatttcccattttctcaggcagccagaggtcatgaatgtgaggatactgggaggttggagcaacgttcttgggaggcataaggaagagcgaatgcttcaagatccccgcagcccaaactactcgcctgctttgccccctaatgcatttttctctgctgctccgtagctgtccgacctcttcagatctcttagtccaccctgccgtcttcctttatgccatgggtcccactgttctttcaactcatccccctttccctcagtcccggagtagctgcggccagcagagggtagactgagagcaggagagaaggacctgcctaggaaccccttctagagatactgcatcctgcctgggagcaagttttccagggcagctttgagaagtcttggagaaacaaacctactaaacctgacagacagtaatactatttgcacaatgcttttctgtgggaaaggtagagccttttcactacgtattgagtacatagagtgtgagggttgacctggaacggctatcctcctggatgacgtgtgttttctgaagaactacatgttcgttgcaactcccacattagaatatgaagtcctaccgagagagatacggagactagacagatacagatgcatttgcatgtgaatacacaatcccacaatacagacgtcaaaacccataccagttattccagagagatggattgggcagaaggcagaaggagaatactctgatcgtttttcggccacgtgtgtgtgttatctcagtgtttctaagaagcgtttgctactttagattttttatttaaaaaaaatagtaataatctattaagtatgagagatgtgcagagaggattagtgatcgagagccatttttgctggtggcaatcatatggtacttttaatgggaatattagaaaggcaccggtaatgaccttgttgcagcacaaaggagagagtgtggggtgcccctgcatgttgtcccacctcttgtgacgtgtatcgttttggaatttccagtggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 68 - protein, 1169 aa, Homo sapiens
MNYCRNPDAVAAPYCYTRDPGVRWEYCNLTQCSDAEGTAVAPPTVTPVPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 69 - DNA, 14070 bp, Homo sapiens
  CDS (79)..(13770)
gaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcatcctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactgtccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagttctgaaagaatctcaacttccaactgtcatggacttcagaaaattctctcggaactatcaactctacaaatctgtttctattccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaacctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccagatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaacaaccacaaaagcccaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgccattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaacttaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcaggaccatgctgagtgggtttatcaaggggccattagggaaattgatgatatcgacgagaggttccagaaaggagccagtgggaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcaatgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaaatgcctatattgatcaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcat

SEQ ID NO: 70 - protein, 4563 aa, Homo sapiens [sequence omitted]

SEQ ID NO: 71 - DNA, 1156 bp, Homo sapiens
  CDS (61)..(1014)
cgcagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgc

SEQ ID NO: 72 - protein, 317 aa, Homo sapiens [sequence omitted]

SEQ ID NO: 73 - DNA, 542 bp, Homo sapiens
  CDS (3)..(542)
ctctgggcgacgttgctggcagaggaaatgagaagaagcccagtagcgtgagggctctgtccattgtcctccccatcgccacggagctgggtctctggtctcgggggcagctgtgtgacagagcgtgcctctccctacggtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgcccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctgtgaaggataa

SEQ ID NO: 74 - protein, 179 aa, Homo sapiens
LGDVAGRGNEKKPSSVRALSIVLPIATELGLWSRGQLCDRACLSLRCSSSSFAWGSSFYGRTGGLRTSTASTLTTPSIRRPQRMRSTFATTRTATATPRDRWSVWRMTWREHLPGVPPLPRTLPETSPALFYSKTEKTKALPARALFYIFIHLGGRTGFGQCPCNGLGWDFGFFLSCEG

SEQ ID NO: 75 - DNA, 3408 bp, Homo sapiens
  CDS (27)..(2519)
cgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgtgggcagccttgtgcctctgctgctgctcttcctgggtcttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagacgaagcagaagcccccgagtcctttccggcggctgccagtcccggggattcagccactggccaccggcggcccccacttggtagccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaaattttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctccccaaagtgctgggatgacaggcatgagccaccacgcctggtctatgaactttttaaaaaggatgtatgtgtataaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaataaaaagtactaacattacag

SEQ ID NO: 76 - protein, 830 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIVGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPDEAEAPESFPAAASPGDSATGHRRPPLGSRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 77 - DNA, 4503 bp, Caenorhabditis elegans
  CDS (1)..(4503)
atgaagttcattggaacttccggttcaattacattgggagcagacatcatatgtcggattggttgtcagttcaattatcaagcatctgcaacctgcaattctgttggggcgtctgtcgcaactgtagtcaccgctgataatcctcgacgttcagtgtctttccctatttattgtgcaagcttagcatatgcaagcagtaaatacaacaatatctcgtcagaaacagtcggaatcgcccatctggaacatagacaatcccttgcgaaagacttcacgtgttccaatgcgagccaagaaacatttggacaaagaagttttgttattcttgctgaaaacacaaaagacactgatgtgatgaaaagttccgtggataacgttttcagaaacaagaatagtatcttctaccagcttagtccttttgtcaactctgctcctccacagcgatatgcaaactttttcgctgttctgaataaatgttccgaaactgcacaaacggagcaaagctctgactatggaacgtttttaacaaaagttatgaatgttactagtaaatcacaacaacgacccaatgatccaagtgatcctgtcaaggtcacaaatttcctgcctcaagcaattgcaggagcgaacgcctattctgacattctgcttgtgattaattataacgtgtctaccattaccgacaacgatgctaccgaaatcaaaagtgcattagaaaaacaaagatctcgactatacattctttttgttcaaacgtatttcaactacactgatacttactatgccatgaacaaactggcgattgcgagtggaggagtggcgattcgagtgaacacttatgatgatttgagcacgttctttgcacaatacttcccacttctcgttgcaaatgacattgtcgcaaaagcatatgctgaaaacccaagacctggagttgcgttgaataatgtcaatctacttgctcaacaatatgttcttcttgtaacaaatgaggattcattgggagatggcccggtgccagcatcggtaactgttaccgggattaatgttacacaactaccaacaattggcgaacttcaattattcactcttattccagaaaaggctggaaaattcactccattgttctattcatcttcatcttttgatgacgggtcaaaaattaccattacatacagtgatgcaacaaacccagcaaatccaatttataatggaaatattacgtctgctttaaatgactgcaaatattatgcaaacacaaaaaattacgcctgggcctgtagtatttccgaaatcgcattattattacaattttcaatgagaaatattcagatcgatagagttttgaacggtgaaacgatttcgagaaccttcccaattacttgccttggagcagatgtaggagactgcctcaacggtggaaatctaacagatgctggttcatgcatttgcccattacagtggacaggaactaactgtcaagctccgcaatgcttgaatggaggtacactgaaaactgatgacacttgtgcatgtctcgatagtttcaaaggagatttttgtgaaacaagtacctctgtttgcgctggagctccgacatctccggactatcgctctgaactgagttcattggtaattgttgctgatgtcaacgcattatcaacaagtagtctaagcaatacggtacccggaataactggagtgccaattactgtcattctatatggcgatggaaatgctccaagaattgttcagtctacaactaacagtgagcatctctccgaggtattaggtgcaccgacgggtaccacaacttcaccaagttcaacggcttcaccagcaccatccgcaagtgatatgtataaggctctgaatttggcacttgacaatcagctcaccgaccgtgcatttgtaattgtatacacatcaaattccaatgtcaccattgatcctgactttttgatccgtttggcagtcagaagagccgaagtacgagtgttgtcaacttcgggaactgaaagtcaaaactctataacattatcgctagtcggaaatggaattcctattgcgataaatggcgcgaaagatttcgaaaattacctgacatactacgttgttcccttattccaatcactacaataccaagtgaacactccacaacgagtgttcaatgtgttccaaacaggtcaattctacaactctacgcaaatttctatcccagcagattccacatttgataacgctaaaccaaatctttttgtgcatgtgtacgaaggtcgcattaattattcagatccttcaacaaatggaaacgaggttggcaattctactatatactttctcccttatgaccccacaaaacctatcaacttaattgtgaataataatggcacgaccggttactacgcaatcgaagtcatcggatatctaaagacatcatatggtttcaatattgataatgctaacggatcaaatgaaaacctgaactcgggagtagtatataaccaacaaaacacattgaatatctattctgcgccgttttcacagcttcctaaaactgatccatcaaacttcccatatctcacacttggagaaattgccagtaacggaacagttttacctgcaacaacagttttgtttacaagaaaaagtggtgcgtcctgtttttacagtcacttcaccgttcttgatgtctgctcccaaagcacaacaattggatatcaggcacagttgaccacaagaacaagcaccttgacaaataggattcaacaatttgtgctgacatgctttaaaacaagttatgcaaataatgatacttcctgccatggacatggatcaccaatggcaacctgtgcctgtaatgctgacttcggaggaattgattgcactgaaccggcttgtgtaaatggaggtgttcgggatgggtcggtttgtcgttgtcctgtaagattctatgggcttcgatgtgaagaatgtgagtctaggcaaaatctgcctataagaaaattatccacacctaattacggacaaattactgacaaattactggtaaagaaattcattcagttcccttttgaatcagaaccagcttcgtctactgtctccgtgataacttcaactactatgctgccttctacgtcaactgttgctccaagcacaagccaatcaacaatagtttccactgttactacacagtcaccaagtccttcaacaacagctccaaaacaagtccgagctgctgcattcattattgactgcatgggaactgatgattatgctttcaatcagacattcaaatcgattgcacagtacttcaagacatttggctatagccattacatcatgttaaccaataatttgaatggaagtttacaattgaacaatggaagtttactatttgaagatttccaacaatattcagatgagagtatgattatgagcaaactacccctgtattggagtttaagagccaccccaagtagaaccgctagcgtcagcaacgcgctcagtaagattcttgcaagttacaatagaaacggtacagagttcaaaaactctgtaagcatgaatattttttatgcaactcaaatagggctgggcgatgaggatccaactgcagcaggcttagaagttttcaacaagagcgcgattgtatattctgcattcgcaaaaaatgccaaccagacaattgtgacttctcttcaaaaattcagtaccgacgtaaccactgctagagattattacagtggtctttctgatatgtatgaaagcactcaaccccagggttcgaatgagctccctccaaaaccggatcaacttagttgtgtgtacggcctgcaatcgaatatcaaaattgcaattgatagatccaactcgtcaaacccagaggttaacacaattatgaataatttccttgtcaatttccgtcttggatttaattatattgaaaatgatgacaacagatgcggggataagttaccagaattttataccggacgaactgcattaacggcgttcccgtattatgatgccattgcaaaaatagcaacattttgtccatctcaatacacttcgatgctatcattccaagtcgtcggaagccaattacagccaaacttcaccgataaatatgtcaaagtcattagcaagaacattaacagtgccgattgttcgtgcaacagattcaacgacactaacactgcgaagtttatcatttggatgcctcgttctgcagcgcccgtcactgatgatgattatttaaccttgctcaaactcaacaccacaaatgcatatcactttgtcgttccattttacgatagtgctgataacagtaccgatttgtactaccagattcttgtgaagcaagcaggacccgaaggtcccgattattattggttaccaaatgcagttaatgctacaaatttgcaaacgaatgtaataaatattctatacgagaagctttgccaaactgccggtgttgacccaacagcaatcccaccataa

SEQ ID NO: 78 - protein, 1500 aa, Caenorhabditis elegans
MKFIGTSGSITLGADIICRIGCQFNYQASATCNSVGASVATVVTADNPRRSVSFPIYCASLAYASSKYNNISSETVGIAHLEHRQSLAKDFTCSNASQETFGQRSFVILAENTKDTDVMKSSVDNVFRNKNSIFYQLSPFVNSAPPQRYANFFAVLNKCSETAQTEQSSDYGTFLTKVMNVTSKSQQRPNDPSDPVKVTNFLPQAIAGANAYSDILLVINYNVSTITDNDATEIKSALEKQRSRLYILFVQTYFNYTDTYYAMNKLAIASGGVAIRVNTYDDLSTFFAQYFPLLVANDIVAKAYAENPRPGVALNNVNLLAQQYVLLVTNEDSLGDGPVPASVTVTGINVTQLPTIGELQLFTLIPEKAGKFTPLFYSSSSFDDGSKITITYSDATNPANPIYNGNITSALNDCKYYANTKNYAWACSISEIALLLQFSMRNIQIDRVLNGETISRTFPITCLGADVGDCLNGGNLTDAGSCICPLQWTGTNCQAPQCLNGGTLKTDDTCACLDSFKGDFCETSTSVCAGAPTSPDYRSELSSLVIVADVNALSTSSLSNTVPGITGVPITVILYGDGNAPRIVQSTTNSEHLSEVLGAPTGTTTSPSSTASPAPSASDMYKALNLALDNQLTDRAFVIVYTSNSNVTIDPDFLIRLAVRRAEVRVLSTSGTESQNSITLSLVGNGIPIAINGAKDFENYLTYYVVPLFQSLQYQVNTPQRVFNVFQTGQFYNSTQISIPADSTFDNAKPNLFVHVYEGRINYSDPSTNGNEVGNSTIYFLPYDPTKPINLIVNNNGTTGYYAIEVIGYLKTSYGFNIDNANGSNENLNSGVVYNQQNTLNIYSAPFSQLPKTDPSNFPYLTLGEIASNGTVLPATTVLFTRKSGASCFYSHFTVLDVCSQSTTIGYQAQLTTRTSTLTNRIQQFVLTCFKTSYANNDTSCHGHGSPMATCACNADFGGIDCTEPACVNGGVRDGSVCRCPVRFYGLRCEECESRQNLPIRKLSTPNYGQITDKLLVKKFIQFPFESEPASSTVSVITSTTMLPSTSTVAPSTSQSTIVSTVTTQSPSPSTTAPKQVRAAAFIIDCMGTDDYAFNQTFKSIAQYFKTFGYSHYIMLTNNLNGSLQLNNGSLLFEDFQQYSDESMIMSKLPLYWSLRATPSRTASVSNALSKILASYNRNGTEFKNSVSMNIFYATQIGLGDEDPTAAGLEVFNKSAIVYSAFAKNANQTIVTSLQKFSTDVTTARDYYSGLSDMYESTQPQGSNELPPKPDQLSCVYGLQSNIKIAIDRSNSSNPEVNTIMNNFLVNFRLGFNYIENDDNRCGDKLPEFYTGRTALTAFPYYDAIAKIATFCPSQYTSMLSFQVVGSQLQPNFTDKYVKVISKNINSADCSCNRFNDTNTAKFIIWMPRSAAPVTDDDYLTLLKLNTTNAYHFVVPFYDSADNSTDLYYQILVKQAGPEGPDYYWLPNAVNATNLQTNVINILYEKLCQTAGVDPTAIPP

SEQ ID NO: 79 - DNA, 369 bp, Homo sapiens
  CDS (89)..(268)
gtattaagctcaatattagcattaatccatttatttgttaaaatctaatattgtattcttgtcttaaacagtgactttgtttttgtaggctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcctgtaagtaccaaatatgaatggcaatattattacattttaatttaattaattcaatggcattggcaaggcataattttataatttagctcattagctatgct

SEQ ID NO: 80 - protein, 60 aa, Homo sapiens
AASHIYQNQFVQMILNSLINKSKSSMFQVRTLRELLWGYRDPFLSLVPYPVTTTVGLFYP

SEQ ID NO: 81 - DNA, 3412 bp, Homo sapiens
  CDS (27)..(2519)
cgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacag

SEQ ID NO: 82 - protein, 830 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 83 - DNA, 3763 bp, Mus musculus
  CDS (48)..(1139)
gaggtcctcgactgtttcagtttttcactcttagcatgaatttggaaatgacttttgatgacaagatgaagcctgcgaatgacgagcctgatcagaagtcatgtggcaagaagcctaaaggtctgcatttgctttcctccccatggtggttccctgctgctatgactctggtcatcctctgcctggtgttgtcagtgacccttattgtacagtggacacaattacgccaggtatctgacctcttaaaacaataccaagcgaaccttactcagcaggatcgtatcctggaagggcagatgttagcccagcagaaggcagaaaacgcttcacaggaatcaaagaaggaactgaaaggaaagatagacaccctcacccagaagctgaatgagaaatccaaagagcaggaggagcttctacagaagaatcagaacctccaagaagccctgcaaagagctgcaaactcttcagaggagtcccagagagaactcaagggaaagatagacaccatcacccggaagctggacgagaaatccaaagagcaggaggagcttctgcagatgattcagaacctccaagaagccctgcagagagctgcaaactcttcagaggagtcccagagagaactcaagggaaagatagacaccctcaccttgaagctgaacgagaaatccaaagagcaggaggagcttctacagaagaatcagaacctccaagaagccctgcaaagagctgcaaacttttcaggtccttgtccacaagactggctctggcataaagaaaactgttacctcttccatgggccctttagctgggaaaaaaaccggcagacctgccaatctttgggtggccagttactacaaattaatggtgcagatgatttgacattcatcttacaagcaatttcccataccacctccccgttctggattggattgcatcggaagaagcctggccaaccatggctatgggagaatggaactcctttgaattttcaattctttaagaccaggggcgtttctttacagctatattcatcaggcaactgtgcataccttcaagacggagctgtgttcgctgaaaactgcattctaattgcattcagcatatgtcagaagaagacaaatcatttgcaaatttagtgaatctaaagattctggagaagaccatgagaagacttttgactgtcgctctgaaatttaagctattttttattacctgcatgtaaagcatgttggccttgacatctgtcagttacctgatagctacagttcacctcatcaaagacaaggaccagaagcaaatactggtggatccagatgtttgaaatctttgtatcaaaacgtgtgagttcaattgtttatccatatacactggccttgcccctccaaagtctcccaaccaacctgcactccttcttcccctttgtgttttaaatgatgcttcctgcctgacctggccatgctttgtactcagtctcctctacctcagtatgcctcctgttgctgcatgaaagacaggatgtagaaatcctcctcaagtgcaggcagagggctcaaaggcaaagctcgtccgagaaataacatgcaaagaaacagaactggaaaaactacactgcaaacaggaactcatgatctctaaaaagccatggcttgatctttatgacaggagtccatctccagactgcacttttacacacatattttttattttacttttattgtgaagtttatggatagtttgcctacttgaattctgtgtaccacatgagtgcctggtgccactgaagatcagaagaggacatcagattctctggatctggaattccagatggttgtaagctgctatgtagatgtgaagaattgaattcggtgtcccctggaagaacagccagtactctttgccatgagctatctctcaagctcctgtgatcaattcttgtatcagttatgtctccatttttgctctaccaaagaacagtgttataactttaaaacagtaagtattttcattattctaggggtaatatagcagatatagatagagatagagatagagatagagatagagatagagatagagatagagatagagatagagataggtataggtataggtataggtataggtataggtataggtataggtataggtataggtagatagagatagaggtagaggtagaggtagaggtagaggtagaggtagaggtagaggtagagatagagatagagatagagatagagatagagatagagatagagatagagatagagatagagatagagatagagatagagatagagatagagatagagatagagatagagatagatagtgtgtgtgtgcgtgtgtgtgtttctatgctaggtacgatccttgaggagatgagacagttttgtgtgaaatgagtttgtaataatccaaatttaaaaataaattcgatgattacctgtagtggtcatattaccacagccaagatgatgaacatacctgtcacttctgccccttcccaaagcctcctccctaaaacaaacaccaatctgctttcagttcgcattttatagagcttctcattttgtttttaagacagaatctcatatagtcctggctggcctggaactcactacacagagcaggctggcctccaccttctagagctcctcctgccagactcccaaaccttaagactgaaggagtgccctgccgtgtgtgactcaaacaccttaatgtgaatggaacagcataagatgtccaggttttttcagtccagcttcttccacttggtacaatttttaatttttgtgttcatacatctccaccacagtgtttgtatcagttcatcattcttttcaaatgttgagccttcccctgtggatctatagtgtcatttgttatctgtgtatttgttgatgccatttgggttggttttgtctggggtcacctacaaataaagctgctatggatgtccatggacaaggctaatatcttaggtaagcacctacgagtaagatgcttgggtcattcagtgtgggaatatatggttggctattttaaccattcctgtttgaaaacattaattttttttatttttgaaatcaattttttaaaaaattaattagtctattttacatctcaaccccagtttctcttcctcctctcctctcaaccttctcccaccttctctccctgaccccatccacccctcctccctttctctccagaagaggggaggcctcccatggatgccaaccagcctcagcatctcaagttacagtaagaataggtttgtcttctcctgtgaaaatcttaatttttagatttatctattatatatgcagtactttgcttgcacatatgtattggtaccatgtacatgcatggtaccagagaaagtcagaagaggccattgtattttctgggactggaattacagacgtttttgaacaatcctatagactctgggaactgaacccaggtcgtctggaaaggcaagcagtgctcttaacccctgagccatttcttctggccttttagcaatttttattaatatataactgtgtatacttgcacttttagctcgaagttcttaagtgtcaaatagtcttggatttattttcatgttatcactgtctgtacaatttctgtgatgaaataactgagcatatattttgagaatttggttttcttaaattttaaatctgaaggatttacatatttgagaataaaaaccagccagatacataaaaaaaaaaaaaaaaaaaaa

SEQ ID NO: 84 - protein, 363 aa, Mus musculus
MTFDDKMKPANDEPDQKSCGKKPKGLHLLSSPWWFPAAMTLVILCLVLSVTLIVQWTQLRQVSDLLKQYQANLTQQDRILEGQMLAQQKAENASQESKKELKGKIDTLTQKLNEKSKEQEELLQKNQNLQEALQRAANSSEESQRELKGKIDTITRKLDEKSKEQEELLQMIQNLQEALQRAANSSEESQRELKGKIDTLTLKLNEKSKEQEELLQKNQNLQEALQRAANFSGPCPQDWLWHKENCYLFHGPFSWEKNRQTCQSLGGQLLQINGADDLTFILQAISHTTSPFWIGLHRKKPGQPWLWENGTPLNFQFFKTRGVSLQLYSSGNCAYLQDGAVFAENCILIAFSICQKKTNHLQI

SEQ ID NO: 85 - DNA, 1102 bp, Homo sapiens
  CDS (44)..(1102)
gcgtcgacgtcttgccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccattgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacaatcatccccatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaa

SEQ ID NO: 86 - protein, 352 aa, Homo sapiens [sequence omitted]

SEQ ID NO: 87 - DNA, 25 bp, Unknown
  Primer
gggaattccatggagagtcaaccag

SEQ ID NO: 88 - DNA, 21 bp, Unknown
  Primer
gcaagcttaacttgttaatag

SEQ ID NO: 89 - DNA, 22 bp, Unknown
  Primer
gggaattccatggagaaaagcg

SEQ ID NO: 90 - DNA, 22 bp, Unknown
  Primer
gcggatcctcactttttctttg

SEQ ID NO: 91 - DNA, 50 bp, Unknown
  Primer
ggggtaccccgaaggaggaaaaaaaaatgtctacaaacgataatataaag

SEQ ID NO: 92 - DNA, 42 bp, Unknown
  Primer
tgctctagagcattaattaatttctgcttctatagtttttat

SEQ ID NO: 93 - DNA, 24 bp, Unknown
  Primer
ggcgtcgacatgtataagagatta

SEQ ID NO: 94 - DNA, 24 bp, Unknown
  Primer
gccggatcctcactttttctttgt

SEQ ID NO: 95 - DNA, 25 bp, Unknown
  Primer
tttagaagatgaaccgtaagcctag

SEQ ID NO: 96 - DNA, 21 bp, Unknown
  Primer
gatacctctttcgtctgctga

What is claimed is:

1. A method of delivering a therapeutic agent to a solid tumor characterized by hypoxia, acidosis and hypertonicity comprising loading the therapeutic agent into mature human sickle red blood cells or human nucleated sickle cell progenitor cells which express at least one hemoglobin S allele and administering said mature human sickle red blood cells or human nucleated sickle cell progenitor cells, into which said therapeutic agent is loaded, into the blood circulation of a human patient having said solid tumor wherein said mature sickle red blood cells or nucleated sickle cell progenitor cells accumulate in said solid tumor in order to treat said solid tumor.

2. The method according to claim 1, wherein the therapeutic agent loaded into the mature human sickle red blood cells or human nucleated sickle cell progenitor cells is an antitumor virus, toxin, siRNA, drug or prodrug.

3. The method according to claim 1, wherein said at least one hemoglobin S allele expressed in said mature human sickle red blood cells or human nucleated sickle cell progenitor cells is linked to a second hemoglobin allele selected from the group consisting of hemoglobin S, hemoglobin A, hemoglobin C and β thalassemia hemoglobin.

4. The method according to claim 2, wherein said antitumor virus is selected from the group consisting of herpes simplex, adenovirus, vaccinia, Newcastle Disease virus, reovirus and autonomous parvovirus.

5. The method of claim 2, wherein said toxin consists of:
 (i) a wild type staphylococcal enterotoxin or wild type streptococcal pyrogenic exotoxin protein which wild type protein has the biological activity of stimulating T cell mitogenesis via a T cell receptor vβ region;
 (ii) a biologically active variant or fragment of a wild type staphylococcal enterotoxin or streptococcal pyrogenic exotoxin, which variant or fragment:
  (a) has the biological activity of stimulating T cell mitogenesis via a T cell receptor vβ region and
  (b) has sequence homology characterized as a z value exceeding 13 when the sequence of the variant or fragment is compared to the sequence of a wild type staphylococcal enterotoxin or a wild type streptococcal pyrogenic exotoxin, determined by FASTA analysis using gap penalties of −12 and −2, Blosum 50 matrix and Swiss-PROT or PIR database; or
 (iii) a biologically active fusion protein comprising:
  (A) said variant,
  (B) said wild type staphylococcal enterotoxin,
  (C) said wild type streptococcal pyrogenic exotoxin, or
  (D) said fragment, operably linked to a peptide or polypeptide fusion partner.

6. The method of claim 2, wherein the toxin is a staphylococcal enterotoxin selected from the group consisting of SEA, SEB, SEC, SED, SEE, SEG, SEH, SEI, SEJ, SEK, SEL, SEM, SSA, and TSST-1 or wherein the toxin is a Streptococcal pyrogenic exotoxin selected from the group consisting of SPEA, SPEB, SPEC, SPEC, SPEJ, SPEH SME-Z, and SME-$Z_2$.

7. The method of claim 2, wherein said toxin is fused to a fusion partner selected from the group consisting of an antibody or antibody fragment specific for an antigen or receptor expressed on a tumor cell or tumor vasculature and an Arg-Gly-Asp (RGD)-containing polypeptide.

8. The method of claim 5, wherein said peptide or polypeptide fusion partner is a coaguligand selected from the group consisting of inactivated factor VIII, tissue factor, thrombin, factor V/Va, factor VHI/VIIIa, factor IX/IXa, factor X/Xa, factor X1/XIa, factor XH/XIIa, factor XIII/XIIIa, factor X activator and factor V activator.

9. The method of claim 2, wherein said drug is a chemotherapeutic agent selected from the group consisting of a heavy metal, an antimetabolite, an anthracycline, a vinca alkaloid, an anti-tubulin agent, an antibiotic and an alkylating agent.

10. The method of claim 2, wherein said drug is a chemotherapeutic agent selected from the group consisting of docetaxel, paclitaxel, taxotere, cisplatin, doxorubicin, vinorelbine, gemcitabine, camptothecin, dactinomycin, mitomycin, caminomycin, daunomycin, tamoxifen, vincristine, gemcitabine, vinblastine, etoposide, 5-fluorouracil, cytosine arabinoside, cyclophosphamide, thiotepa, methotrexate, actinomycin-D, mitomycin C, aminopterin, and combretastatin.

11. The method of claim 1, wherein said administration of said mature human sickle red blood cells or human nucleated sickle progenitor cells is by infusion or injection, intravenously or intraarterially.

12. The method according to claim 2, wherein said toxin is selected from the group consisting of a pertussis toxin, a pseudomonas toxin, a verotoxin, a ricin, a *C. perfringens* exotoxin, a granzyme B, a perforin, a complement membrane attack complex, a staphylococcal alpha hemolysin, an *Escherichia coli* hemolysin, a staphylococcal erythrogenic toxin, a streptococcal erythrogenic toxin, a staphylococcal coagulase, a staphylococcal beta hemolysin, and a Clostridia perfringens toxin.

13. The method of claim 2, wherein said toxin is a mutant or variant of a wild type toxin which has the biological activity of the wild type toxin and has sequence homology characterized as a z value exceeding 13 when the sequence of the variant or said fragment is compared to the sequence of a wild type toxin, determined by FASTA analysis using gap penalties of −12 and −2, Blosum 50 matrix and Swiss-PROT or PIR database or a biologically active fusion protein comprising said mutant or variant fused to a peptide or polypeptide fusion partner.

14. The method of claim 1, wherein said therapeutic agent is selected from the group consisting of an enzyme, an apolipoprotein, an angiostatin, a staphylococcal protein A, a chemokine, a chemoattractant, a cytokine, a heat shock protein and a thrombospondin.

15. The method of claim 14, wherein the enzyme is selected from the group consisting of a carbohydrate modifying enzyme, a galactosyltransferase, a staphylococcal hyaluronidase, a streptococcal hyaluronidase and a staphylococcal coagulase.

16. The method of claim 7, wherein said receptor expressed on said tumor cell or said tumor vasculature is an epithelial growth factor.

17. The method of claim 1, wherein therapeutic agent is loaded into the mature human sickle red blood cells or the human nucleated sickle progenitor cells by endocytosis, electroporation or physical encapsulation.

18. The method of claim 1, wherein said therapeutic agent is loaded into the human nucleated sickle progenitor cells by transfection.

19. The method of claim 18, wherein said therapeutic agent comprises recombinant DNA, cDNA or genomic DNA.

20. The method of claim 19, wherein said recombinant DNA, cDNA or genomic DNA is incorporated into a vector, an autonomously replicating plasmid, a virus or the genomic DNA of a prokaryote or eukaryote.

21. The method of claim 20, wherein said virus is selected from the group consisting of a retrovirus, adenovirus, or a herpes virus.

22. The method of claim 18, wherein said therapeutic agent loaded into said nucleated sickle progenitor cells by transfection is operably linked to a hypoxia sensitive global operator and promoter.

23. The method of claim 2, wherein said toxin is fused to EGF or inactivated factor VIII.

* * * * *